United States Patent 11,446,398 (REGULATED BIOCIRCUIT SYSTEMS) - sequence listing, part 69

SEQ ID NO: 168075 - DNA, 3990 bp, Homo sapiens
  Payload ID: 13059
  Gene Symbol: KCNJ14
  Gene Name: potassium channel, inwardly rectifying subfamily J, member 14
  Uniprot ID: Q9UNX9
  ENST ID: ENST00000391884
  CDS Start-End: 477-1787
ggcagaggttgcagtgagctgaggttgcggtgagctgagattgtgccgctgcactccagcctggcgacaaagcacgactccgtctcaaaaaaaaaaagaaaagaaaagaaaaaagttaaaaaaaaaattacccaggagtggtggtgtgcacctgtagtaatcccagctactcaggaggttgagacaggagaatcgcttaaacttgggacgcggagattgcagtaagccaggatcatgccactgcactccagcttgggcgacagagcgagactctgtctccaaaaaaaaaaaaaaaaaaaaaatgcgtatcgttccacctatttgacagatgaggccactaagccccaccagaaagcatgcttggccgatgagctcatccattcctgttgcccctgacgtttctgccggtttcttgtcccagcaggttgggggcgcctgccccccactaggccaagtggagggggtccctccgtccaatgggcctggccagggccctacgccgcctcagcggcgccctggattcgggagacagccgggcgggcgatgaagaggaggccgggcccgggttgtgccgcaacgggtgggcgccggcaccggtgcagtcacccgtgggccggcgccgcggtcgcttcgtcaagaaagacgggcactgcaacgtgcgtttcgtaaacctgggtggccagggcgcgcgctacctgagcgacctgttcaccacatgcgtggacgtgcgctggcgctggatgtgcctgctcttctcctgctccttcctcgcctcctggctgctcttcggcctggccttctggctcattgcctcgctgcacggcgacctggccgccccgccaccgcccgcgccctgcttctcacacgtggccagcttcctggccgccttcctcttcgcgctggagacgcagacgtccatcggctacggcgtgcgcagcgtcaccgaggagtgcccggccgctgtggccgccgtggtgctgcagtgcattgccggctgcgtgctcgacgccttcgtcgtgggtgctgtcatggccaagatggccaaacccaagaagcgcaacgagacgctggtcttcagcgagaacgccgtcgtggcgctgcgcgaccaccgcctctgcctcatgtggcgcgtcggcaacctgcgccgcagccacctggtcgaggcccacgtgcgtgcccagctgctgcagccccgtgtgaccccagagggtgagtacatcccgctggaccaccaggatgtggatgtgggctttgatggaggcaccgatcgtatcttcctcgtgtcccccatcaccatcgtccatgagatcgactctgccagtcctctgtatgagctaggacgtgccgagctggccagggctgactttgagctggtggtcattctcgaggggatggttgaggccacagccatgaccacacagtgtcgctcgtcctacctccctggtgaactgctctggggccatcgttttgagccagttctcttccagcgtggctcccagtatgaggtcgactatcgccacttccatcgcacttatgaggtcccagggacaccggtctgcagtgctaaggagctggatgaacgggcagagcaggcttcccacagcctcaagtctagtttccccggctctctgactgcattttgttatgagaatgaacttgctctgagctgctgccaggaggaagatgaggacgatgagactgaggaagggaatggggtggaaacagaagatggggctgctagcccccgagttctcacaccaaccctggcgctgaccctgcctccatgatgcaaactgatgtccccttccccgtgtatgcccccttccccaaggtagcaagatggagggatggggctctctcctgggatgggggcaggtgttcctgaataccgacaggcctgctgggtaaatgactaggtggtaaggttctgccatgcctggtgacccaccatggacatactggaccttaattcctctgcttctgtgctccctcctgagaaccctttatgagcctgattcctcagtctcaccagaattctggatcacccaagaggaaaagactggcagttctagattcctctatatggggagacctggattgttgaccagggtgagaagccaatggtatagactgcctctggggaagcaagttggcagttcttgaacagcatcagatatcaagagtttgtaggtctggattcacctaagattcaagggagtgttgcttctcaactcagccaactgagtagcaaatcatttgttctagaccacctaaggagggaaggttatggaatgccccaagtattcaagatcatcttgattgaccaaagaccaaaaaaaaaaaaaagacctgtggttccagaaagctcattagttgagattctgtgagtctaggttgaccacagaggcaagcactggtgagtctaggacagattttacgtggagagttgaactactccagaaactaaagagtaatgtttctagaatgcacaaaacattgttagtctgtgggtttagaaagactgaagtgacagattaagagttcttgatattagataactccaacttctggctgtagagcacccagccaagagaataagcagtgctttgaaaggatccactgggtgggttgtttttttttaaagtgccattctagaatgtccaaagggaatcaggattctgtggctgtagactgatcacagagtcaaggaagcagtggcaattctagatatctgagattttgctggttccagtttgcccaatggagttgagaatctcaatgattctagatgacttcttgtggttctgtaatgccaaaaggaatgaaggctccagggatacagagttgtccattaccaaagcctggaagttctcatcacctccaggtggactgcttggcagtgctaggaggtggactcaggacttcagaagcaacatttctggcctgacctggaaggtgaaggtgaaggtgagaccctgtagggcacagggctaattagtggacaagggaagggggaggcccagggctggtgagtctagaatgctctggaaccctacacctagtgatgtgtgtctatttctttttctttttcttttttttttttttttgagactgagtctcgctctgccgcccaggctggagtgcaatggcgtgatctcagctcactgcaacctccgcctcccggcttcaagtgtttctcctgcctcagtctcctgagtcgctgggattacaggcatgagccactatgcctggctaatttttgtatttttagtagagacggggtttcgccatgttggcgaggttggtcttgaactcccgacctcagatgatccacctgcctcggtctcccaaagtgctgggattacgggtgtgagccaccatgcccagccgtgtgtctgtttcttaaagatattatacatatgtatattatatatatgtaatataaatacagatatctatctattttttcccttggtccctacaacaggcttagagatggagtgctagctaattggaatgaggtccttttcaaggaccccagaagctttgctctaaatcccaatgctgccccaacttactgtgtcactttggactcctcttcatgtcagtttccccatctgtaaaaacgggatattggaacttgaagttcttcaggggcctttccagcaggatgagtcctcactacaccaagggtgggatgggcattcgagtcctggggatttccctcctctccccagtgctggatcatacggccttccaggagacgctgggatgtaagatactcttggaggctggctctgaactcgggtgtctgaatcacagggcaagggtaggcgtgggctgtggctaacagccagagtcacttccctggcctagcttggggacctggggaggaggaggtagctctggacaccagggttcttcccattgtgggagagtgagtgttttagggggagacctgtcccccagattaaagaactgggagcccta

SEQ ID NO: 168076 - DNA, 8399 bp, Homo sapiens
  Payload ID: 13060
  Gene Symbol: KCNJ15
  Gene Name: potassium channel, inwardly rectifying subfamily J, member 15
  Uniprot ID: Q99712
  ENST ID: ENST00000328656
  CDS Start-End: 304-1431
aggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacgcacacatgcacacacacatacgcacacgtaaacacatgcacacatgcacacacgcgcacacatgcacacacgcacacacttgcacaggccctggctcttcaagcataatcatggtagtcatcagtgaaagacatttgaggttaagacagcaagtccttgacaaatatgttcatgtctatttggttctagttctataaaaatatgaacattgggactcagagaaaatggggaaaataaagtggattcaggttatcagtgaaatgatggtatagattacagcaaatctggatatatattgatgttactgcatttgcaaatgtcctcccattaaacagaaaatgtggctaaaatccctggcctggaactgaactagtttaaggcaggtgtaagaatagtgggaggaaagtttgtgaaagtttaaagaatgccctcaatccatgaacgagagggaggatgttgtctttaattatttagaaggtttttttttccttgtctgttgataattttatggaaggttgctttagatctccattccttaaaaaaatattacatgtcagtgtagttagatattatctcttttagttattatacttgctatttttactgtatagtgtggtataatcaacaaaaaataatgccacgggcatgtttacaccttttctgttgcactattaaattcttttcacagtattcatatcaatgctaatttgaatgtgatgccaattaaaaatcttgttcatttatattgtatatggtacaaggacgtagcataagatccaaaaaaaattttgtattgtcatttagcatatcaatttcagccaaatttggaagacttgatcatcttatcttttgctctacacactcaaaacaaatattgcagcagaaatatcaccttaaaaatatcttattttatatttagataatattgaaatcacagtctattaaaattggaaatttaattcaaataaaaatcaaacaaaatagttgtttcaatttatctaaatatctggtcttaagagtgccttaagagtgtctcgtttttaagagtgtcttaaaaaccaatatatgtataagtcaacaaatcatataatattcaataaatagctctgaagttgtatctgatttgaaacttaccattttcctggaaccttaactattattactttgtacgtaatactttcatgttactatgctaacaaaggatttaggtagccaacttaatttattatatctggtcggtcttctgcttgaaacagattcacactcaacacccaactaaggaggagccaaagtagtggagtattcctgacccaaaaaggcttttgaattttgaaacatttctaatgtgttaggttttctcaatgagaccattaaaaaacgttgtgttccatttgagaaaccagagtcaacagcagtaaatcagtgtgccccacaagccacgtcttattcagcaataaaatagtgctcacatggtgcctggcagacagtggctctggacagcaaagcactgagtcacccaaccccactcctttgggatggggttgggagtcatgcattggctccctttttcatcctggggaaattacaacacaacgcagagtgtccagaaatctaaagagctggtttaaggtgaaaaaaatgccatgaatgaatgaaccagatgtttaataaatcaaaacaactattttgttggatttttatttgaattaaatttcccaatttttaatagactgtgatttcaatattatcgaaatgtaaacaaagatatatttttaaggtggcatttctactccagcatgaaaaaaatagtggcatttgcactctagcattattctgtctcccttatttgagtcttcaatatatatgcccagctggagggagaagaagagaaaaatgaaagcactaggcctttgactaggtttggttctatatgctgtcatgatgttcaaaatgtcagacatttgaccacatggcacagtgaatactctcacgctctcaattttggctttcattcttgctagacttttcttctattaaatttctgaaataactagttttttttttttgaacttgaaaatcagctttttattttttttaattttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtgatgttccccttcctgtgtccatgtgttctcattgttcaatttccacctatgagtgagaacatgcggtgtttggttttctgtccttgagatagtttgctgagaatgatggtttccagtttcatccaataactagttttatcatagctttccatgatgtaattttttaagcgaaaggtactaacatttccagtcttgatttccaagttttgtggtgtgcactcgaaatctagtctctgattgttaaactctgggtaggtacaagaggctcttaattttcttcctcccaggaggacttacttacacttaaaggtcaaaagcttaacattcacttctaaatggttaactgcatacactttaccctttgtaaacttcaatttatctttttttttttttttttttttttttttttttgatactgggtctcgctctgtcgcccaggctgctagagtgcagtggcgcgatttcggctcactgcaagtccgcttccaggttcacgccattctctccctcagcctcccgagtagctgggactacaggcgctcgccaccatgcccggctaattttgtttttgtgtttttagtagagacggggtttcaccgtgttaaccaggatggtctcgatctcatgacctcgtgatctgcccgcctacaagccaggtgtggtggtgcgtgcctgtaatcccagctactcaggagactgaggcaggagattcgcttgaacccgggaggtggacgttgcagtgagctaagatcgcgccactgcactccagcctgggcaacaaaagtaaaactccgtctcaaaaaaaaaaaaaaaaagaaaaagaaaaagaaaagaaaagaaaataaacgtggcaaaactagaccttcagacacttcacttcacttaaccctatggccctccttatcttgcacccaatttcttttcaacatcatacatgcttggttgactgtttcttcatatttgctgttcattctataaagtcaaatagattggtgggttaaaaaataatcaattcaaattcaaattaggaatttatggacattcagatatccacatatttgagggcaggaatttttacttttcaattggtatgttggcagtgtgtaaaaatagaagaccaagagaaggcggttgattggagttgatacttaatagctaataaaaattacaagaaaggatggtggaagtcaaaggacagaactgatacacgagtataaaagccaacgatgtcatatatgtaggcaaagtctttgtaatctgaatataatgccagagagctagggctgccaggcactctgtatgtgcagaatatgtcctatatggagtaattttttatttgtgtagacttttttaggataccttaaatgtcttacatgcaacctttttttccccatatattacaaaattgccttggaaattagacaaatcttcaaacttaactgaaactcctgtcctgaatagttatttgccaaatctgacaaatttacaaagagtgttcacataatcccaaactatgcccatttctacaagagaaatacatgcctctttatttggagtttatgatattcatacaactagtagtagagtcagggagtattccagaaacatatttccctggcttgcccaattatcaagggaaaatttcagctgaacacggggaacccagtctttgacactcctgtgtgcagtgtggagcagcgtgcactgtctgagtctccatagtgaggaatggtcttccctggggcatcaccctagaaggatgggctcaaagtcgccctccacgtgggtgcacaggagcccagattctcaagccccagttgcagaattaggctgatggttttacaaaagagtcctcctaaaagtccatcactaagttttgtttggttagcaacccttgccacatgatgtagtacttagctataattttatttttattcaaggccaaatcttatctggtgtccatgccttcccacctacttaaaatttcaaatttcaccctcaaaaatatttcagtaaataaaagttagatctactcaaaattagactccaagggaattactatagttgattatagagtatctatttccttaaaaaaaaaaaaccataagttgttgactctgagctaggaaatgcgtgatctctcagctgacttactttatgcaaatttacttaatattatagaagagtaaagagcttccaagaaggtgattggagggaagttcaaagggaagatttttttcattcactgtagttttagctgtattctttcatctgcaatcaaatctcaggattaaggatgtcgtattacatcaaatcattacaggaagtatgactgtatcagcggctttttacaaaaacaaacctccagatcacaaaaggaagctgtgtttgtgtactgacacgaagtgttacgtagcagccaggagaggaaggatagcagccgacttggatccatttttgaggaattatttctgtaaggtgtcatggaattgtaagttacaaaaataaggcttttgtaaacagaatctccattccagaaggacggactccaaaatgctacttaatgaaattcatgggaatgttatggtgatggaaatcccaaatgacatgtagattttatatgcaaacaatcccactgcttgtaactcctggcagtgtgtacttaccaaaatcttgatcacacttaggtctcttgctatatatagaaccacatctgatccttatacagtgttgcaagatatatgtccttgctttcccatggttcttaagtgagtcttaagcttggatttgctccagcagaatggtggtttgtgtttctcaaggctgagctactatttggtgcatgtcggaaatctcacactaactgtggatactctgtcatcactgaacccaatcatacaatgaccagacagctttaaatacctacttttgtatgctatgaattcatccgtttacttgtcaaatcctttatttccatatgtgtctccatcaccttttttttctctccggataaatggaattactgtaacttgtgaaacaatggcaaacactataaagctaattttacagtcttga

SEQ ID NO: 168077 - DNA, 532 bp, Homo sapiens
  Payload ID: 13060
  Gene Symbol: KCNJ15
  Gene Name: potassium channel, inwardly rectifying subfamily J, member 15
  ENST ID: ENST00000398925
  CDS Start-End: 349-532
aggtgtttggagagcccggactggatgcccactagaatcctgtgctggcaacctgtctggactgagcatttctctgacttgacataacttcccatccagccaggagtctgcactcttcagtctttgcaggacaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatga

SEQ ID NO: 168078 - DNA, 665 bp, Homo sapiens
  Payload ID: 13060
  Gene Symbol: KCNJ15
  Gene Name: potassium channel, inwardly rectifying subfamily J, member 15
  ENST ID: ENST00000398927
  CDS Start-End: 196-665
aaaatattctagactcttcccttccagcgctcactgtttacttcctctgcacttccccttcctgcctccccgtgtgccggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattga

SEQ ID NO: 168079 - DNA, 715 bp, Homo sapiens
  Payload ID: 13060
  Gene Symbol: KCNJ15
  Gene Name: potassium channel, inwardly rectifying subfamily J, member 15
  ENST ID: ENST00000398928
  CDS Start-End: 246-715
aggtgtttggagagcccggactggatgcccactagaatcctgtgctggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattga

SEQ ID NO: 168080 - DNA, 2914 bp, Homo sapiens
  Payload ID: 13060
  Gene Symbol: KCNJ15
  Gene Name: potassium channel, inwardly rectifying subfamily J, member 15
  Uniprot ID: Q99712
  ENST ID: ENST00000398930
  CDS Start-End: 355-1482
acaggagcacgtagcctgcaggtgtgggttgtacacaggcttccccctgctgagtcagttccccagatctcttcatcacttccccagatctctgggatcttcagctgagattgggccccagcacctggactcaaggacaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtc

SEQ ID NO: 168081 - DNA, 2747 bp, Homo sapiens
  Payload ID: 13060
  Gene Symbol: KCNJ15
  Gene Name: potassium channel, inwardly rectifying subfamily J, member 15
  Uniprot ID: Q99712
  ENST ID: ENST00000398932
  CDS Start-End: 519-1646
ctgtctttcacccataaaaactgaagccatgtgccagaagccctcgtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggacaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaa

SEQ ID NO: 168082 - DNA, 2815 bp, Homo sapiens
  Payload ID: 13060
  Gene Symbol: KCNJ15
  Gene Name: potassium channel, inwardly rectifying subfamily J, member 15
  Uniprot ID: Q99712
  ENST ID: ENST00000398934
  CDS Start-End: 255-1382
agcacaggagcacgtagcctgcaggtgtgggttgtacacaggcttccccctgctgagtcagttccccagatctcttcatcacttccccagatctctgggatcttcagctgagattgggccccagcacctggactcaaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtcc

SEQ ID NO: 168083 - DNA, 2583 bp, Homo sapiens
  Payload ID: 13060
  Gene Symbol: KCNJ15
  Gene Name: potassium channel, inwardly rectifying subfamily J, member 15
  Uniprot ID: Q99712
  ENST ID: ENST00000398938
  CDS Start-End: 355-1482
ctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaa

SEQ ID NO: 168084 - DNA, 727 bp, Homo sapiens
  Payload ID: 13060
  Gene Symbol: KCNJ15
  Gene Name: potassium channel, inwardly rectifying subfamily J, member 15
  ENST ID: ENST00000417042
  CDS Start-End: 670-727
actctctctctctgtctctcactttctctcctttcctccctccctccctccctccctccttccctatccctccctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggacaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccaggaatgtgggggaaatttatgtcagtcatcaggcaggtactagaagatgctaggggcctcacagacagcttgttcccggctgttaacatggagcagagcgttccctggggctgagcatgggagcccagcacttcttatagtgtttccagagcctggcaatggatgccattcacatcggcatgtccagcacccccctggtgaagcacactgctgggg

SEQ ID NO: 168085 - DNA, 521 bp, Homo sapiens
  Payload ID: 13060
  Gene Symbol: KCNJ15
  Gene Name: potassium channel, inwardly rectifying subfamily J, member 15
  ENST ID: ENST00000419868
  CDS Start-End: 105-521
gcagtagcagaatcccatggtagccaggtgggtgaaggggagcgaggacgttctacctgccttgaagaagacacctgacctgcggatgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgt

SEQ ID NO: 168086 - DNA, 711 bp, Homo sapiens
  Payload ID: 13060
  Gene Symbol: KCNJ15
  Gene Name: potassium channel, inwardly rectifying subfamily J, member 15
  ENST ID: ENST00000443341
  CDS Start-End: 593-711
ggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcaggagatgttggaaacagagactggatccctgaggagatgctgttagaccaggctgagctcaaggcttgtccctaaggcagctggtgaaggaaaggttcgacttggtggtagaagccctggactggagtccccacctatgggctgagggatcctccacaagtgattcaacttcttagtttctcacctacaaaaggtgggagttaaccaagaaagggagaaaatgaagaaccttcaggaaggaattcatgtgccagatgtgggctgagagggcacccagctgctcaggaaggggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaat

SEQ ID NO: 168087 - DNA, 1115 bp, Homo sapiens
  Payload ID: 13060
  Gene Symbol: KCNJ15
  Gene Name: potassium channel, inwardly rectifying subfamily J, member 15
  ENST ID: ENST00000438657
  CDS Start-End: 380-1115
gtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagcc

SEQ ID NO: 168088 - DNA, 595 bp, Homo sapiens
  Payload ID: 13060
  Gene Symbol: KCNJ15
  Gene Name: potassium channel, inwardly rectifying subfamily J, member 15
  ENST ID: ENST00000547341
  CDS Start-End: 451-595
cgtcttcagaggaaggatagctgtacagcgtggtgaaggactcaatgagaagtgaacagtgagagagttttcttcattttgaggaaccctaaacacctatctttcccaaggcaacctgtctggactgagcatttctctgacttgacataacttcccatccagccaggagtctgcactcttcagtctttgcagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 168089 - DNA, 555 bp, Homo sapiens
  Payload ID: 13060
  Gene Symbol: KCNJ15
  Gene Name: potassium channel, inwardly rectifying subfamily J, member 15
  ENST ID: ENST00000549932
  CDS Start-End: 411-555
cgtcttcagaggaaggatagctgtacagcgtggtgaaggactcaatgagaaggtgcattgcccatccttcagagagctctgtgtgaatccataaaaggtgcttaaagcttttcactccatgaagcctcatctgtctcatgaaagcaataaatataacttttaagtggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 168090 - DNA, 740 bp, Homo sapiens
  Payload ID: 13060
  Gene Symbol: KCNJ15
  Gene Name: potassium channel, inwardly rectifying subfamily J, member 15
  ENST ID: ENST00000549805
  CDS Start-End: 596-740
cgtcttcagaggaaggatagctgtacagcgtggtgaaggactcaatgagaaggtgcattgcccatccttcagagagctctgtgtgaatccataaaaggtgcttaaagcttttcactccatgaagcctcatctgtctcatgaaagcaataaatgtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 168091 - DNA, 304 bp, Homo sapiens
  Payload ID: 13060
  Gene Symbol: KCNJ15
  Gene Name: potassium channel, inwardly rectifying subfamily J, member 15
  ENST ID: ENST00000548700
  CDS Start-End: 160-304
cgtcttcagaggaaggatagctgtacagcgtggtgaaggactcaatgagaaggcagtagcagaatcccatggtagccaggtgggtgaaggggagcgaggacgttctacctgccttgaagaagacacctgacctgcggagtgagtgaccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 168092 - DNA, 626 bp, Homo sapiens
  Payload ID: 13060
  Gene Symbol: KCNJ15
  Gene Name: potassium channel, inwardly rectifying subfamily J, member 15
  ENST ID: ENST00000549158
  CDS Start-End: 551-626
cgtcttcagaggaaggatagctgtacagcgtggtgaaggactcaatgagaaggtgcattgcccatccttcagagagctctgtgtgaatccataaaaggtgcttaaagcttttcactccatgaagcctcatctgtctcatgaaagcaataaattgaacagtgagagagttttcttcattttgaggaaccctaaacacctatctttcccaaggcaacctgtctggactgagcatttctctgacttgacataacttcccatccagccaggagtctgcactcttcagtctttgcagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaaca

SEQ ID NO: 168093 - DNA, 413 bp, Homo sapiens
  Payload ID: 13060
  Gene Symbol: KCNJ15
  Gene Name: potassium channel, inwardly rectifying subfamily J, member 15
  ENST ID: ENST00000551422
  CDS Start-End: 269-413
cgtcttcagaggaaggatagctgtacagcgtggtgaaggactcaatgagaaggtgcattgcccatccttcagagagctctgtgtgaatccataaaaggtgcttaaagcttttcactccatgaagcctcatctgtctcatgaaagcaataaatgcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 168094 - DNA, 313 bp, Homo sapiens
  Payload ID: 13060
  Gene Symbol: KCNJ15
  Gene Name: potassium channel, inwardly rectifying subfamily J, member 15
  ENST ID: ENST00000547595
  CDS Start-End: 169-313
cgtcttcagaggaaggatagctgtacagcgtggtgaaggactcaatgagaaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctac

SEQ ID NO: 168095 - DNA, 3049 bp, Homo sapiens
  Payload ID: 13060
  Gene Symbol: KCNJ15
  Gene Name: potassium channel, inwardly rectifying subfamily J, member 15
  Uniprot ID: Q99712
  ENST ID: ENST00000613499
  CDS Start-End: 489-1616
attaactggcattctttaaaaaggcatcagttttcttttgcacaggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtcc

SEQ ID NO: 168096 - DNA, 3046 bp, Homo sapiens
  Payload ID: 13060
  Gene Symbol: KCNJ15
  Gene Name: potassium channel, inwardly rectifying subfamily J, member 15
  Uniprot ID: Q99712
  ENST ID: ENST00000612702
  CDS Start-End: 486-1613
attaactggcattctttaaaaaggcatcagttttcttttgcacaggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccaggaatgtgggggaaatttatgtcagtcatcaggcaggtactagaagatgctaggggcctcacagacagcttgttcccggctgttaacatggagcagagcgttccctggggctgagcatgggagcccagcacttcttatagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtcc

SEQ ID NO: 168097 - DNA, 4062 bp, Homo sapiens
  Payload ID: 13061
  Gene Symbol: KCNJ16
  Gene Name: potassium channel, inwardly rectifying subfamily J, member 16
  Uniprot ID: Q9NPI9
  ENST ID: ENST00000283936
  CDS Start-End: 547-1803
agattcccagggaggaactgtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 168098 - DNA, 4009 bp, Homo sapiens
  Payload ID: 13061
  Gene Symbol: KCNJ16
  Gene Name: potassium channel, inwardly rectifying subfamily J, member 16
  Uniprot ID: Q9NPI9
  ENST ID: ENST00000392670
  CDS Start-End: 494-1750
gagaactcagtggcctttgtctgtggtgaatgtatccggaaaggcaaagaagagagagattctcctgtggggtttctcatctccatggcggtaggtgctgacagcttcagaagggtactaacagggccaagagaaaagggccctgagatgctcagctacggtgctcttacaagatgaaaaggacatggggttcagatctgcacttcatcatctttcactaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 168099 - DNA, 3981 bp, Homo sapiens
  Payload ID: 13061
  Gene Symbol: KCNJ16
  Gene Name: potassium channel, inwardly rectifying subfamily J, member 16
  Uniprot ID: Q9NPI9
  ENST ID: ENST00000392671
  CDS Start-End: 466-1722
agattcccagggaggaactgtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 168100 - DNA, 582 bp, Homo sapiens
  Payload ID: 13061
  Gene Symbol: KCNJ16
  Gene Name: potassium channel, inwardly rectifying subfamily J, member 16
  ENST ID: ENST00000587892
  CDS Start-End: 476-582
gatgctcagctacggtgctcttacaagatgaaaaggacatggggttcagatctgcacttcatcatctttcactaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatgactaaaggtggagttagggggaaatgagtttaatgtgaagtagtactcctgtcagttctgtttgtcctgggaagtatacaaggaagaaaagcctccgtggaagagagagcaagcaccaggtgctgaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgatt

SEQ ID NO: 168101 - DNA, 4014 bp, Homo sapiens
  Payload ID: 13061
  Gene Symbol: KCNJ16
  Gene Name: potassium channel, inwardly rectifying subfamily J, member 16
  ENST ID: ENST00000585558
  CDS Start-End: 389-1750
gagaactcagtggcctttgtctgtggtgaatgtatccggaaaggcaaagaagagagagattctcctgtggggtttctcatctccatggcggtaggtgctgacagcttcagaagggtactaacagggccaagagaaaagggccctgagatgctcagctacggtgctcttacaagatgaaaaggacatggggttcagatctgcacttcatcatctttcactaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaa

SEQ ID NO: 168102 - DNA, 569 bp, Homo sapiens
  Payload ID: 13061
  Gene Symbol: KCNJ16
  Gene Name: potassium channel, inwardly rectifying subfamily J, member 16
  ENST ID: ENST00000591891
  CDS Start-End: 464-569
ttatccagacaggggaattgcaatggagagagagtaattcaagcagagtcagctgtgtgggagatcggagttttattattactcaaatcagtctcccagatcagagtttttaaggatagtttgtcgggtatgggcttggaaagtgaggagtgctaattggttgggttgaaggtaaaatcatagggggtcgaaacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgat

SEQ ID NO: 168103 - DNA, 3684 bp, Homo sapiens
  Payload ID: 13061
  Gene Symbol: KCNJ16
  Gene Name: potassium channel, inwardly rectifying subfamily J, member 16
  Uniprot ID: Q9NPI9
  ENST ID: ENST00000589377
  CDS Start-End: 164-1420
gagcattctctaccattgcccagctgaaagcacctagctcatagattctctgtggggagagtgaataaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaa

SEQ ID NO: 168104 - DNA, 589 bp, Homo sapiens
  Payload ID: 13061
  Gene Symbol: KCNJ16
  Gene Name: potassium channel, inwardly rectifying subfamily J, member 16
  ENST ID: ENST00000587698
  CDS Start-End: 397-589
gagatgctcagctacggtgctcttacaagatgaaaaggacatggggttcagatctgcacttcatcatctttcactaaggagtaactcaagatgattttgatgttgcagttttaaatttcactttgacttgagctgggaaatcctttggcctattataccatggatgctaaaaatgactaaaggtggagttagggggaaatgagtttaatgtgaagtagtactcctgtcagttctgtttgtcctgggaagtatacaaggaagaaaagcctccgtggaagagagagcaagcaccaggtgctgaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactc

SEQ ID NO: 168105 - DNA, 1897 bp, Homo sapiens
  Payload ID: 13061
  Gene Symbol: KCNJ16
  Gene Name: potassium channel, inwardly rectifying subfamily J, member 16
  ENST ID: ENST00000586462
  CDS Start-End: 264-1637
acaatcttttgtactattgatgtgacaatatgtacattaagtggggtgaagaattaagtcattctcttcataatcaggtgataacaaccttctcctttattgagaatcaagcatctcagagcgagcgtgaatggatattagagtttctgcctcagtgttctcaacagcttctactggtaaagcaagttacagctagtaacttggtcagggtttttggatataaactttattgtttagagtgtagaccaacctacatttaaaatatgatacttcagaagtgcagaaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttaca

SEQ ID NO: 168106 - DNA, 4190 bp, Homo sapiens
  Payload ID: 13061
  Gene Symbol: KCNJ16
  Gene Name: potassium channel, inwardly rectifying subfamily J, member 16
  Uniprot ID: Q9NPI9
  ENST ID: ENST00000615244
  CDS Start-End: 675-1931
agattcccagggaggaactgtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatgactaaaggtggagttagggggaaatgagtttaatgtgaagtagtactcctgtcagttctgtttgtcctgggaagtatacaaggaagaaaagcctccgtggaagagagagcaagcaccaggtgctgaaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgc

SEQ ID NO: 168107 - DNA, 2196 bp, Homo sapiens
  Payload ID: 13062
  Gene Symbol: KCNJ18
  Gene Name: potassium channel, inwardly rectifying subfamily J, member 18
  Uniprot ID: B7U540
  ENST ID: ENST00000567955
  CDS Start-End: 371-1672
agcaggccacagggaggcttgggcacagtcagctttccgtcctgttgggaagcctgtttctgctttcagtgcctacgtggtgtcaggaacgccggtcacagtgaacgcctgcaggacccacactgctgcatcgtctctgtgggacagatactgaagccagggcttggcttaccctcgtgacagtctcccgaggatgttctagtgactggatcctttccagctggtgcctgggaaatggcagccactactaattcagccttgaagacagtaccgtgcctactcagcaccattacgtagaagacagaactcaagaggagccgccctgcctggagctagcctgggggtgagccagggtcccccaacccccgggatgaccgcggccagccgggccaacccctacagcatcgtgtcattggaggaggacgggctgcacctggtcaccatgtcgggcgccaacggcttcggcaacggcaaggtgcacacgcggcgcaggtgccgcaaccgcttcgtcaagaagaatggccagtgcaacattgcgttcgccaacatggacgagaagtcacagcgctacctggctgacatgttcaccacctgtgtggacatccgctggcgctacatgctgctcatcttctcgctggccttccttgcctcctggctgctgttcggcgtcatcttctgggtcatcgcggtggcacacggtgacctggagccggctgagggccacggccgcacaccctgtgtgatgcaggtgcacggcttcatggcggccttcctcttctccatcgagacgcagaccaccatcggctacgggctgcgctgtgtgacggaggagtgcctggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggcaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgaaattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagtgccaactccttctgctatgagaacgagctggccttcctgagccgtgacgaggaggatgaggcggacggagaccaggacggccgaagccgggatggcctcagcccccaggccaggcatgactttgacagactccaggctggcggcggggtcctggagcagcggccctacagacgggggtcagagatctgagccaaccttggccgacatgcagcatccacccctggccggggagaggccccgcggtcgctcaggggccctgggtttgagcagaacgggcccagtgccctgggttgcagactcagtagcgttttagtcgttttatgtttctttgcaaaggcctcagaaggttggccggagagggggcagccagagcggcagcccccggcctcagaggctatcacaggctcagggcaaagaagtggcctcctggggggccaggccacgggggccagggcttctgcctgaagatggagctgcagcctgcggggaagcagcccagctcgatggtgggcccagcctctgctgtccaaggctggctagctgcggtgctccttgctggtttttaacttggggagaaacaccgggtttcagctttctcgaccttagcttgggtgagactgtttacaaaaaaaaaaaaaaccatgcaattggagaaaaaaattttaattcatagggggcaaaaagaacaattagaattccatgggtctgccagg

SEQ ID NO: 168108 - DNA, 5392 bp, Homo sapiens
  Payload ID: 13063
  Gene Symbol: KCNJ2
  Gene Name: potassium channel, inwardly rectifying subfamily J, member 2
  Uniprot ID: P63252
  ENST ID: ENST00000243457
  CDS Start-End: 384-1667
gcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggacatgttctctggatgtcagctgagtcattaaagtaactctgcatgtcagtagacagaccttggtagaaccacaaggctcccagagacacccatctctcctcatttttttggtgtgtgtgtcttcaccgaacattcaaaactgtttctccaaagcgttttgcaaaaactcagactgttttccaaagcagaagcactggagtccccagcagaagcgatgggcagtgtgcgaaccaaccgctacagcatcgtctcttcagaagaagacggtatgaagttggccaccatggcagttgcaaatggctttgggaacgggaagagtaaagtccacacccgacaacagtgcaggagccgctttgtgaagaaagatggccactgtaatgttcagttcatcaatgtgggtgagaaggggcaacggtacctcgcagacatcttcaccacgtgtgtggacattcgctggcggtggatgctggttatcttctgcctggctttcgtcctgtcatggctgttttttggctgtgtgttttggttgatagctctgctccatggggacctggatgcatccaaagagggcaaagcttgtgtgtccgaggtcaacagcttcacggctgccttcctcttctccattgagacccagacaaccataggctatggtttcagatgtgtcacggatgaatgcccaattgctgttttcatggtggtgttccagtcaatcgtgggctgcatcatcgatgctttcatcattggcgcagtcatggccaagatggcaaagccaaagaagagaaacgagactcttgtcttcagtcacaatgccgtgattgccatgagagacggcaagctgtgtttgatgtggcgagtgggcaatcttcggaaaagccacttggtggaagctcatgttcgagcacagctcctcaaatccagaattacttctgaaggggagtatatccctctggatcaaatagacatcaatgttgggtttgacagtggaatcgatcgtatatttctggtgtccccaatcactatagtccatgaaatagatgaagacagtcctttatatgatttgagtaaacaggacattgacaacgcagactttgaaatcgtggtcatactggaaggcatggtggaagccactgccatgacgacacagtgccgtagctcttatctagcaaatgaaatcctgtggggccaccgctatgagcctgtgctctttgaagagaagcactactacaaagtggactattccaggttccacaaaacttacgaagtccccaacactcccctttgtagtgccagagacttagcagaaaagaaatatatcctctcaaatgcaaattcattttgctatgaaaatgaagttgccctcacaagcaaagaggaagacgacagtgaaaatggagttccagaaagcactagtacggacacgccccctgacatagaccttcacaaccaggcaagtgtacctctagagcccaggcccttacggcgagagtcggagatatgactgactgattccttctctggaatagttactttacaacacggtctgttggtcagaggcccaaaacagttatacagatgacggtactggtcaagatgggtcaagcaagcggccacaagggactgaggcaagcacaatggtttcaaagaaagactgtaagctccatgattagcataaagcactaaccatgtctccatgtgacccgatggcacatagatgttgtagaataagttatgggtttttatgttttgttttgtgtttttccaaaacttgaacttgcaggcaagccttggttgggtatttgatttatccagaatgcttctctttagggaacaaggatgtttttaatggcataacaaaggcaagactctgccttaatttttgaaaagctgctaactacatgaacacaaatgtgtatttttgttgcagtgtagttttccttttgtgtaattttaaagtcagtgttgaattttattgaaagctcatgatgcgcttcaaagtggcaagtatttggctattaactgccaaaacaagagcctgattttttgaggccagtaattcgtttgctagaattgattttttttctctctctctttgttacataagggcattatgtaacactagccgaatggtagcctctgggttgttgtttttttcttttcctccatgatgttaatgggttatctcaaattttaagttaaactacctaaaataaataccaaagataatgcatatttttgcacagtggagcttacacttaaaagaaaacaaagccccatgggctgccttgaaatcaagagacaataactttgaacctcagcaagaccttgaaccgccggttcattttgcaccttattcagaaaatagagcatcatactcaccgagtctagtcagtgtagtgcttttaaaaattttgtcctttcatgtaacttttttattttaagaggaagaagaagaaaggggcacacacacacaataccgacgtctatcctttcctgctaggcagtgctggccaggctcatgtgtagtgtgcgagatggtgatgtactcttatatttttctgggcttttccttttgcacattccaaaattcatttcataagacaagatcttcataggacctccttggcatcctggcattctcaaaactgagccatccagcatgaaagataaatgggtttaaacccttgctgctgaatttattgcctggactgtcaggacatcaccagcccaccttcaccttagggaagatgccacacctggcctccacacttgctcttctgatcagtctgtctggattgagtcctacagtgtcagatagggcggcaaatgccaaagcagggaaacagggaggtgtggacaagccagtttgatgcagcacttcagatcaagtgcttaggaaggagaggaaacttgccttttttatggcagaggatagtaatgaaaatgtctcagtattttagggtcaatgagagccataaaaatataacataatcacaagtaaaggagataatggtctaaaacagctatttcccttttctgtgtgcatacttatgactgaatgtgagctaagcattttctcctgtggagccctagagcaggttactaaggaaggacacattgttttccagaagcctcccctgcctggctgactgccttgctagaaacataattttttttttctcactgaagctcaataatggaactctttttttttttttttttaatttaaagttccctatttgtgaattctgggattactgacttttctttttaattggagtctcaaaatcaactctcttatggtattatatctctgtatgccattaaaaaacagcttgttctagaatcatgtattttgtaaactgatgtttgtgatggtctctggttcttgaacagccatatctgaatgccgtgcctgcaaaactatgacaatttttgctgttttcagccttcagatttgatggcttgggaaactgaggtgttattttcaatgaaacaaagaaagagatgttaagcaagtggttgttttagatccaaatgtaaaggcaggtttgggaaggtgtttaaagagttggaggaattggggattgagttgtaaagaaaacttacagaagaggcaacaatttggttcttgacagtgagaggatattgagggcttcagctgctgctattatgatgttttgcaaaggaaaataatcaaaccaaagagtattcagtgatatgtaaattaaatgaagatacagtggagaatgggggtgaccacaaaagaggctccccctaaacacacagtgctgccacttaaaaagacttgagaaatttgaaagggggtgggtatggggggggcaagaaagagggagggaaatctttcaacttatttctgaaaaagagaaaaaaatataaaatttctggtgcacaggtttgttttttcaagaaaattttgcagaagctatgtttttaaagtgtacattttataaagtttatcagatattttcatatttaaagccaaatgtaaatagaggtctgtaaagaaaaataattgccatagaaagtataatttcagtgcagtaatttctgagagctagtacctatatgctaccggttagcatggttttagcaaatatataccagccttataaggttcgtattgctatgttcttctgttatttatttcagcatggactgttcatttgaaacctttttctagttattagcgttttaacagttacaagctttaaatggcaattttttttttttttttttttttttttttttttttgtcaagagccaagacacaggtaatgcacgacattgattgctgcattttaccttcaaaatatttgtccttattgactgggtctccttaattaatgtacacatgtcattagaatgcagacggaggggactcaccatgaatatctggggttgattcccagatgtgtgttgcttctctattgcaagcagattccctgttggatttacttcggatttattcccttttaaagaatttttgcccatatctggaagggcactatatttttgggaggagccatagattcctggttatcctatttttaaacaaaatgtagacaaagtgaactctattttgattattgagaaaggagtagttttctatccctctaagagtatacttgaatcagacattttaaggatgtcactatggcactgttgtcatttccaaattcctagaaaagtttgttttactttgtttttattctgttaatgcattctttcttctctttacttcctttcttaccagtacactcctatctcaactctgtttatttgatgagttctgtcccgtaaatcatatttcccttacaattaataaatgtcacttcatattttataataaaccactcagtaaaagcaaaagcttgtcctgagaagtagagtgagttctttttcactctgtgtctaataatgttaaggtgggaaaaaaaaaagtgtggcatagctacctgcccatccccaaccctcagcaaagtagaatctcttttctggtaattttgggtttccgctctgggctctggcaagttgaacaatcctagccattgacaatcgtgatagttattattttcccatttgctgtctttttgtatctaaagtcttcctattgtactgcacaaaccatggattgtacatatttttatatattatgtcttattttattatttctaaataaaaaaattaaaaattgaaaacaaa

SEQ ID NO: 168109 - DNA, 1685 bp, Homo sapiens
  Payload ID: 13063
  Gene Symbol: KCNJ2
  Gene Name: potassium channel, inwardly rectifying subfamily J, member 2
  Uniprot ID: P63252
  ENST ID: ENST00000535240
  CDS Start-End: 402-1685
tgggaggcgctgaagcgagggcagatctgagtgtctgtaggagttgctattccaaaaaaaatcattactctctaattgttctgattttagatcagcaaagcgtgccgggcggtggtggagagactgagggcggacaaggcgagagggaacgagccgtccacccttcggagaagcctaggcgccttgacatgttctctggatgtcagctgagtcattaaagtaactctgcatgtcagtagacagaccttggtagaaccacaaggctcccagagacacccatctctcctcatttttttggtgtgtgtgtcttcaccgaacattcaaaactgtttctccaaagcgttttgcaaaaactcagactgttttccaaagcagaagcactggagtccccagcagaagcgatgggcagtgtgcgaaccaaccgctacagcatcgtctcttcagaagaagacggtatgaagttggccaccatggcagttgcaaatggctttgggaacgggaagagtaaagtccacacccgacaacagtgcaggagccgctttgtgaagaaagatggccactgtaatgttcagttcatcaatgtgggtgagaaggggcaacggtacctcgcagacatcttcaccacgtgtgtggacattcgctggcggtggatgctggttatcttctgcctggctttcgtcctgtcatggctgttttttggctgtgtgttttggttgatagctctgctccatggggacctggatgcatccaaagagggcaaagcttgtgtgtccgaggtcaacagcttcacggctgccttcctcttctccattgagacccagacaaccataggctatggtttcagatgtgtcacggatgaatgcccaattgctgttttcatggtggtgttccagtcaatcgtgggctgcatcatcgatgctttcatcattggcgcagtcatggccaagatggcaaagccaaagaagagaaacgagactcttgtcttcagtcacaatgccgtgattgccatgagagacggcaagctgtgtttgatgtggcgagtgggcaatcttcggaaaagccacttggtggaagctcatgttcgagcacagctcctcaaatccagaattacttctgaaggggagtatatccctctggatcaaatagacatcaatgttgggtttgacagtggaatcgatcgtatatttctggtgtccccaatcactatagtccatgaaatagatgaagacagtcctttatatgatttgagtaaacaggacattgacaacgcagactttgaaatcgtggtcatactggaaggcatggtggaagccactgccatgacgacacagtgccgtagctcttatctagcaaatgaaatcctgtggggccaccgctatgagcctgtgctctttgaagagaagcactactacaaagtggactattccaggttccacaaaacttacgaagtccccaacactcccctttgtagtgccagagacttagcagaaaagaaatatatcctctcaaatgcaaattcattttgctatgaaaatgaagttgccctcacaagcaaagaggaagacgacagtgaaaatggagttccagaaagcactagtacggacacgccccctgacatagaccttcacaaccaggcaagtgtacctctagagcccaggcccttacggcgagagtcggagatatga

SEQ ID NO: 168110 - DNA, 5021 bp, Homo sapiens
  Payload ID: 13064
  Gene Symbol: KCNJ3
  Gene Name: potassium channel, inwardly rectifying subfamily J, member 3
  Uniprot ID: P48549
  ENST ID: ENST00000295101
  CDS Start-End: 478-1983
caggcaggtaaaggcagcttcttaggcagccagcgagttggcaggtgggttgggactcgcttgtcaactcattaattttaagcagtcagtttgggggtactgcaggataatcaggagggccgtggggagtcaagaggtgacccgggatgccggtggtggggaaagaaaagaggagcctctggaagcttggaggcaaaattgcgcttgggttcctgttccttgcatccctcctggcttgagtgcgggagaacactttttaaagactcaccttggaaagaaggcctccgtcccaggggagaaggagaggcgtctgcagggggcagagaccgcagctacctgccgggtgcgccccccacccaggagcgctcgcttcgccccctttcctcccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaatctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccatgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacaagcatatttgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaatatgtatgtctaattgagtctcttttttattctgttttcttgtttatggcatttgttgtaacaggatagactttttcctcacctaggaaacctatcccatgcctgtcacttatagttcaggaggaagtttttgcacagaccagagagaaattaaaattagatgataaattgaagatatcttacacacagttttttggtgaacactgattttattggtgtcttagatccctagtctacccaaataattttaacagtactgttttttctaatcctgaagtctgatatttatgactcattagcaggaatcaaaactagtgatcagtagaacactttcaaaataaaaatttggaatgcagacttttatgaaaatttaaaagtgctccttaacagaatatcatgggttttcctataaaacttctttaagtattgtaattccagtctgccccaactttaaaaaaaattcttattaatatgtcagtcattaattgctagtttgggctctcattatttcctgttttttaacaattttgtgataattttattattggcaaattaatacatcaacacttaaatcattgactataataataccttctggctacctctgtatcaaccaaattctgtaggtgcaaacatataccagggaattcttactggcaaaatgatcaatctggagtgtgcatccactgtgaatggagcaaattgccctatacccattgataacctagctttcttagtttgtagatgtaggaaacaaaatagtgacagagagagaagggggtccacagggcatggtatatttatcagcagtggaaaaaaagtgcatagatcatttagtccaagaacttaaaactaaatagagccataatttactttggagagtcattttaatttgtctttggtaccaaggagaagacggaaccaaaaacaaactctccaagtatattcacacattcaacaaaatttttgcatgccttctatgtcgtaggcatttttagttcctggggatttggacatggctaagtcagagaaggccattgctcaccatgaacactgtataccagaaggagagtggggaggagacaaaaaacaaataagaccacttcagacaatcaaagtatcagttaagagaatgaaaacaggcctgactcagtggctcacgcctgtaatcccagtactttgggaggcggaggttgggggatcacctgaggtcaggagatcgagaccagcctggacaacatggtgaaaacccgtctctactaaaaatacaaaaattaactgggcatggtggcaggcacctgtaatcccagctactggggaagctgaggcaggagaatcgtttgaacctgggaggcggaggttgcagtgagccaagattctgccactgcactccagcctgggtgacagtgcgagactccatctcaacatcaaaaaaaaaaaaaaaaaaaaaaaaaaaaaaaaaaaaaaaaagaataaaaacagggtaacataatgcaaagtaactgtgtggaataaaaattgattattttagaaaatgtgactggcttaggacggggataatatgtgaacagaaatctatctcatgagaaagtgctactgttgtcaaaattaccttatctgagtgaatggtattttttttatcttttccacacatgcgtgggaaaggtatgatttctgcatgtaattgcagtttaacccttatttctaggttgatcataggtcccagtttacccaggaaaattccagtttatacctgttgtacctgtgtaattattggtagcactccctttcactcttacaatgtcttggtttggatgatatatggtgaagtttttgttgaaactaaattatgaagtctgatatatttggataaaaataaagaattgcttttctt

SEQ ID NO: 168111 - DNA, 4523 bp, Homo sapiens
  Payload ID: 13064
  Gene Symbol: KCNJ3
  Gene Name: potassium channel, inwardly rectifying subfamily J, member 3
  Uniprot ID: P48549
  ENST ID: ENST00000544049
  CDS Start-End: 196-903
ctccgtcccaggggagaaggagaggcgtctgcagggggcagagaccgcagctacctgccgggtgcgccccccacccaggagcgctcgcttcgccccctttcctcccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaaggatgacttgtcaagctcgaacatcatatactgaagatgaagttctttggggtcatcgtttttttcctgtaatttccttagaagagggattctttaaagttgattactcccagttccatgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacaagcatatttgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaatatgtatgtctaattgagtctcttttttattctgttttcttgtttatggcatttgttgtaacaggatagactttttcctcacctaggaaacctatcccatgcctgtcacttatagttcaggaggaagtttttgcacagaccagagagaaattaaaattagatgataaattgaagatatcttacacacagttttttggtgaacactgattttattggtgtcttagatccctagtctacccaaataattttaacagtactgttttttctaatcctgaagtctgatatttatgactcattagcaggaatcaaaactagtgatcagtagaacactttcaaaataaaaatttggaatgcagacttttatgaaaatttaaaagtgctccttaacagaatatcatgggttttcctataaaacttctttaagtattgtaattccagtctgccccaactttaaaaaaaattcttattaatatgtcagtcattaattgctagtttgggctctcattatttcctgttttttaacaattttgtgataattttattattggcaaattaatacatcaacacttaaatcattgactataataataccttctggctacctctgtatcaaccaaattctgtaggtgcaaacatataccagggaattcttactggcaaaatgatcaatctggagtgtgcatccactgtgaatggagcaaattgccctatacccattgataacctagctttcttagtttgtagatgtaggaaacaaaatagtgacagagagagaagggggtccacagggcatggtatatttatcagcagtggaaaaaaagtgcatagatcatttagtccaagaacttaaaactaaatagagccataatttactttggagagtcattttaatttgtctttggtaccaaggagaagacggaaccaaaaacaaactctccaagtatattcacacattcaacaaaatttttgcatgccttctatgtcgtaggcatttttagttcctggggatttggacatggctaagtcagagaaggccattgctcaccatgaacactgtataccagaaggagagtggggaggagacaaaaaacaaataagaccacttcagacaatcaaagtatcagttaagagaatgaaaacaggcctgactcagtggctcacgcctgtaatcccagtactttgggaggcggaggttgggggatcacctgaggtcaggagatcgagaccagcctggacaacatggtgaaaacccgtctctactaaaaatacaaaaattaactgggcatggtggcaggcacctgtaatcccagctactggggaagctgaggcaggagaatcgtttgaacctgggaggcggaggttgcagtgagccaagattctgccactgcactccagcctgggtgacagtgcgagactccatctcaacatcaaaaaaaaaaaaaaaaaaaaaaaaaaaaaaaaaaaaaaaaagaataaaaacagggtaacataatgcaaagtaactgtgtggaataaaaattgattattttagaaaatgtgactggcttaggacggggataatatgtgaacagaaatctatctcatgagaaagtgctactgttgtcaaaattaccttatctgagtgaatggtattttttttatcttttccacacatgcgtgggaaaggtatgatttctgcatgtaattgcagtttaacccttatttctaggttgatcataggtcccagtttacccaggaaaattccagtttatacctgttgtacctgtgtaattattggtagcactccctttcactcttacaatgtcttggtttggatgatatatggtgaagtttttgttgaaactaaattatgaagtctgatatatttggataaaaataaagaattgcttttcttc

SEQ ID NO: 168112 - DNA, 2065 bp, Homo sapiens
  Payload ID: 13065
  Gene Symbol: KCNJ4
  Gene Name: potassium channel, inwardly rectifying subfamily J, member 4
  Uniprot ID: P48050
  ENST ID: ENST00000303592
  CDS Start-End: 260-1597
gggagcggcgcgggacggccgggacgcgcggagaccccaagacccacgcgcagaccgagcggcagccggggaggggagcgcgggccggccggccgagttcgcgggcagggggcgccgggactcccctttccgcgcccgggacgccgcccgccggatcgcgccttgggatgtagcgcccgctcgccgcctcccggactctcgtcggaccctccgcccagcggccctgcgtcttcccaggtgaccacgccggcttcaggacatgcacggacacagccgcaacggccaggcccacgtgccccggcggaagcgccgcaaccgcttcgtcaagaagaacggccaatgcaacgtgtacttcgccaacctgagcaacaagtcgcagcgctacatggcggacatcttcaccacctgcgtggacacgcgctggcgctacatgctcatgatcttctccgcggccttccttgtctcctggctctttttcggcctcctcttctggtgtatcgccttcttccacggtgacctggaggccagcccaggggtgcctgcggcggggggcccggcggcgggtggtggcggagcagccccggtggcccccaagccctgcatcatgcacgtgaacggcttcctgggtgccttcctgttctcggtggagacgcagacgaccatcggctatgggttccggtgcgtgacagaggagtgcccgctggcagtcatcgctgtggtggtccagtccatcgtgggctgcgtcatcgactccttcatgattggcaccatcatggccaagatggcgcggcccaagaagcgggcgcagacgttgctgttcagccaccacgcggtcatttcggtgcgcgacggcaagctctgcctcatgtggcgcgtgggcaacctgcgcaagagccacattgtggaggcccacgtgcgggcccagctcatcaagccctacatgacccaggagggcgagtacctgcccctggaccagcgggacctcaacgtgggctatgacatcggcctggaccgcatcttcctggtgtcgcccatcatcattgtccacgagatcgacgaggacagcccgctttatggcatgggcaaggaggagctggagtcggaggactttgagatcgtggtcatcctggagggcatggtggaggccacggccatgaccacccaggcccgcagctcctacctggccagcgagatcctgtggggccaccgctttgagcctgtggtcttcgaggagaagagccactacaaggtggactactcacgttttcacaagacctacgaggtggccggcacgccctgctgctcggcccgggagctgcaggagagtaagatcaccgtgctgcccgccccaccgccccctcccagtgccttctgctacgagaacgagctggcccttatgagccaggaggaagaggagatggaggaggaggcagctgcggcggccgcggtggccgcaggcctgggcctggaggcgggttccaaggaggaggcgggcatcatccggatgctggagttcggcagccacctggacctggagcgcatgcaggcttccctcccgctggacaacatctcctaccgcagggagtctgccatctgacctccaggcccggccctcaccactgcccacaagagcctctgccgggggtgggatgccaggacaccccctcccacactcaggacagagccaaccctggctccgtggaccttctggaggaaggtgggggtttcaaagactgggggaccccttcctcctgactccagcacccaggcctgggaagagctcggccccgatcagcctgagttccgccagcgcctacttctggtggctctaggtccccggatccaccacccttcccccactgactcttcaaggacgtgccctctttgctctcagaaccttggggaaggtggctggactgctgggcgggggacatctcggggtttcagggtgggcagggggttagtttggggaggggggggtgcgtttcttttgcatgactgtggcctgttgctcatgactttcttttgtaaatatctataaatggagacagatggagacaccaaa

SEQ ID NO: 168113 - DNA, 1734 bp, Homo sapiens
  Payload ID: 13066
  Gene Symbol: KCNJ5
  Gene Name: potassium channel, inwardly rectifying subfamily J, member 5
  Uniprot ID: P48544
  ENST ID: ENST00000338350
  CDS Start-End: 353-1612
gagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaaggccagaagctcatagaactttctgaagggagcaggtcatcagccttagcatgagccccggagcatcagtgtctgctggccgttgtgtgcatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagtggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttccttgtgtctcctctgatcatctcccatgagatcaaccagaagagccctttctgggagatgtctcaggctcagctgcatcaggaagagtttgaagttgtggtcattctagaagggatggtggaagccacaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtgaggggtgcagcctccctaagacctcctgtcactggcttcagtgaacacagacactgcagagcctgggagcaggggaggggaatagttgagtgtgctgtttgggggctcaggagccatcaaggc

SEQ ID NO: 168114 - DNA, 5940 bp, Homo sapiens
  Payload ID: 13066
  Gene Symbol: KCNJ5
  Gene Name: potassium channel, inwardly rectifying subfamily J, member 5
  Uniprot ID: P48544
  ENST ID: ENST00000529694
  CDS Start-End: 377-1636
atttgtaccagggacggagggagagaggagagggaggaggggacacacacacacacacacacacacacacacacacacacacacacagagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaacatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagtggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttccttgtgtctcctctgatcatctcccatgagatcaaccagaagagccctttctgggagatgtctcaggctcagctgcatcaggaagagtttgaagttgtggtcattctagaagggatggtggaagccacaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtgaggggtgcagcctccctaagacctcctgtcactggcttcagtgaacacagacactgcagagcctgggagcaggggaggggaatagttgagtgtgctgtttgggggctcaggagccatcaaggctgtggggaggaaccataaacccagccctcacagctcccagcacagggcctccctgagccagtggcatcctgcctgggccccccatggcagtgctgcctcttgtaggtgctggctaagggccaggccaggatgagtttccccatggtgaatgttaccggatggcatctgttctctccatgccctgggtcacttccttttttgggtctcacagacccctccaggggctgacacctagagagaaccatcaccttgtccctcattccttccaccctgaggcttgctgtggactcagagaggagacttacctgatgagagctcaaacctctagtctgggatgagctcacagagccctcatgagttaagatccatccatatcacataggcaattccttttaaatcagataccaacgacccattactgagaggtacagagcgtacagcccttggtgttctctgctgttatctgccaaatgtgtgtgtttttcctctgctgtgttctgtgtgtccagtgtagcctattggagaatcggtctcattagagtgactcttagaaggtggcctgggactagacagcccctctgagcacatgcatagtggcatcagcagcttcctggcctactcccaatcacactgtgccctgcacctcccaccaagggggaaccccagcagctggggcttttcgagtgctttttggcccaagaatctcagagtgcttctaatcatcacagtagtttttgtgttttgttttgttttgttttgttttgttttgttttgttttgtttttttcacaatctcagccagcctgcggtgtgacctggggagaaagttgagtgtcaggggacatgatgagccagttggccctgaaacaggaatggggcaaagagaaaggagagccaggagcatttaaaaatcagcatctgggccaggcaagatggctcacgcctgtgatcccagcattttgggaggccgaggcgggtggatcatgaggtcaggagatcgagaccatcctggctaacacggtgaaaccccgtctctactgaaaatacaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaacatcagcatctgccccagttgtggccaagacactctgacctcagggctcagcaccttcaccatcaagttcagcctgagccaagctcccagcccactgctgaaaagcccctgggcctccctccacaggcagagttacaaccgggagggctgggcagggagggcagggagattgcctggggaaggcaaagggaatggctgcccctcccaggctggaaacaagagggcaagcggggtcagcaggagaattcgggggcagggtgagtgttaagaaaaaaagagtagagaagagcctgaaaatcagcaacttccagggcttttctgatctggaggcccaagagcaagggtggaggggggcagattgtcaggtcccgaaatgtgtgttgacacacacgggcttcgggttagctggcctgacatggagatagagtgccaatgttcccaggccacagaattatggaggcctcacccacagtattcacagctctcaactggcctttgagaatggaagccttttcctgccctggatatggcgcttcttcctgggagaggagcagagccacagagaggtaggaagttgaggcagagcaaagggaaggcttcagagcttaggcccggttcatctcagaagtgttttctaggcctggggctgaaaggaagaggggtggggcagcctgggacgggaactgcctctgtgggctccccactcccagggaggggctccataagctttgctcctgggctggatcttgagaggtgggcagggtcttcccaccagtggcagggtgtgcagttgtggtcccaagccttggagggaatggggaatgggctggcacccggctcagggaaagcagaagcagacagtgccccagcaggggagctgcatgcccccaggagtctcagaaaggcagcccatcactaaggctggatgcctttcagcagagctacagctggagccctccggctgaggccagcactcgcctgggactccctggaccccagggttactaacagcaaaaccattccacacccccttgccagatctaagcctgtcttaggaccgtcagtgcccccaggttagagctcatgggggtcaactaagcgagggagggaaggcgaaggcaaagctggccttgcacctggacagcggcctggctcctccccacacctgccttcatttatgactctgaaacatcccccacctgaccaagggagccactctccagttctctcactccaccagggccctccgtgagccaggaccaggtcacatctctcagccaagtctagaagctctggctagaggagaggaagcgtgcagagggtcctctgccaaagctccctgcctggcccgagcccgggcatgctgggattagtgcaacaccgccccagtgtgcctcctctgccttctatcatgccagtttaaaagcaagaagactcccccttcacatcctgaggaaatccccttcctggtgaccaactgatgcaatgaaagtttgaaaagttcttcattttctagaagttcttgaataaacatggacttactaaatgcagagtctgatgatggacagagtttcaaggggtcactttcaaaacatttaattaatttatttatgtagagacagggtctcgctctgtcgcccaggctggagtgcagtggtacaacctcagctcactgcaacctctgccacctcccaggttcaagcgattctcatgcttcagcctcctgagtagctgggattacaggcatgagccaccacgcccagccattttcaaaacactgctcctgcatacaaaccactcagaggccactgcccttggttctgtgatggctctgagcccatgccatcacatctgatggaccccagagagctgagccgtggtttaagatggggtcatgcgctggtcattcccacagtcttgagtatctccaaaatcccaaagtgatatttcactttcggaccctgaaagtttggagagctggtttcttgccttaatttaagctctctgagaatgtcccctgtagggagaagcctccaggaactcagaatagaactcgttcccactcattttccttgctccaccaatctgacgcctgacagatgtcaccactgcctgaaggatcctgtccccaggccagggcagaatgggcattgcctttgactctccccttcagactcccctcccaccggcctcctgtgtagtcagagaacccactgcccatcgcctcctgctgctgctttgaggttgaggtcctggcttgagcagttaccttgctggagaagaggagcccctgccatctggggagcactgtccctgctcgtgatctgtaacagtggggcgctttttcacaccccttatctcacggcttgcttccagcccccatcaatcctgtgcctcatgtgaggtgagccccagagaaacttaaattgcttgtactgaagttgccaaaaaccaaaagttgcccgttgtcatttttaagactgtgccctgaacacacctctgcccatgcgccatggagcatgtgttaggtgcctgccgtgggtcaggcacttgattctcaaaacactgccgagaagctcttaccaacgtgacagttgaggctgagagaggttcatgagcttgctcaaggccacgggtagtaataagaggcatggccttggtgccaagtgcctcccaaacaaacagccggggccgtggtcctgcctaaactctcacatccacggcaccacgctgggcccaggcaacagagataaggagagccctggctcttgggatggggtcgcgccgattcacatgctgtgccacggagccccggcttccatccatgatgtgcccctgtggcgggataattgggaaacaacctttttctgattcccagagaactaatgagctgcaaaaagagattagacagggaagaattgctttcggggagaagccacttactcggctcgccttggtttttgctaa

SEQ ID NO: 168115 - DNA, 1350 bp, Homo sapiens
  Payload ID: 13066
  Gene Symbol: KCNJ5
  Gene Name: potassium channel, inwardly rectifying subfamily J, member 5
  Uniprot ID: P48544
  ENST ID: ENST00000533599
  CDS Start-End: 91-1350
ggggtgggggtggccttccatcttgtgttctagtgaatcagaacagcccacttcactgatggtgtctttttaactcaaagcatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagtggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttccttgtgtctcctctgatcatctcccatgagatcaaccagaagagccctttctgggagatgtctcaggctcagctgcatcaggaagagtttgaagttgtggtcattctagaagggatggtggaagccacaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtga

SEQ ID NO: 168116 - DNA, 19645 bp, Homo sapiens
  Payload ID: 13067
  Gene Symbol: KCNJ6
  Gene Name: potassium channel, inwardly rectifying subfamily J, member 6
  Uniprot ID: P48051
  ENST ID: ENST00000609713
  CDS Start-End: 591-1862
ggagccgcgtcgcttcgtgcgctgccagcggggctcagccagtcggctggaattgagtagcattcattgaatctgcggatttcatgacgtctctctgcgtggtccaccacttttctcctaaccggggattttttttttcttctgccactcttatctttccccacttcattccacccagtctccctcccccgtccctgcccaaacgcgcgcccctccgcccctcccttggccccagcgcccagccctgctctccgcgctcggccagagggagccagtccggagacggccgcacctggctggagaggctgggcgggcggaggggtggagacccgcggacgccgggaagccggacctggagccggagcagccgcgagcagaatggagtctcctaacagcctctcggtgctgatgtgaaatttgaccatctgattccagtttttttcttttccttttcttttttgcatttccttccctcgccatccgtcgtgtagtgaattgttcagtcttgctccgtttcaagagaggagatcatgattgagtgaagccaccccgtccgcagccaggaaaagcacaaagaagaaactgcaacaatggccaagctgacagaatccatgactaacgtcctggagggcgactccatggatcaggacgtcgaaagcccagtggccattcaccagccaaagttgcctaagcaggccagggatgacctgccaagacacatcagccgagatcggaccaaaaggaaaatccagaggtacgtgaggaaagacggaaagtgcaatgttcatcacggcaacgtgagggagacctatcgctacctgaccgatatcttcaccacattagtggacctgaagtggagattcaacctattgatttttgtcatggtttacacagtgacctggctcttttttggaatgatctggtggttgatcgcatacatacggggagacatggaccacatagaggacccctcctggactccttgtgttaccaacctcaacgggttcgtctctgcttttttattctcaatagagacagaaaccaccattggttatggctaccgggtcatcacagataaatgcccagagggaattattcttctcttaatccaatctgtgttggggtccattgtcaatgcattcatggtgggatgcatgtttgtaaaaatctctcaacccaagaagagggcagagaccctggtcttttccacccatgcagtgatctccatgcgggatgggaaactgtgcctgatgttccgggtaggggaccttaggaattcccacattgtggaggcttccatcagagccaagttgatcaaatccaaacagacctcggagggggagttcatcccgttgaaccagacggatatcaacgtagggtattacacgggggatgaccgtctgtttctggtgtcaccgctgatcattagccatgaaattaaccaacagagtcctttctgggagatctccaaagcccagctgcccaaagaggaactggaaattgtggtcatcctagaaggaatggtggaagccacagggatgacatgccaagctcgaagctcctacatcaccagtgagatcctgtggggttaccggttcacacctgtcctgaccctggaggacgggttctacgaagttgactacaacagcttccatgagacctatgagaccagcaccccatcccttagtgccaaagagctggccgagttagccagcagggcagagctgcccctgagttggtctgtatccagcaaactcaaccaacatgcagaactggagactgaagaggaagaaaagaacctcgaagagcaaacagaaagaaatggtgatgtggcaaacctggagaatgaatccaaagtttagtgccctagctgggcaaacccttctcttctccccccaacacaatctttccttgtctctcattctctttctttttctgtctctcttgctttgttctttatttgtttatatttaatttttacatgaccagaaaacaaatcttcaaggtgtaaaatatctacctgccctctctcagttattcagattgacaaggtagacatggatttgatgaaagtgcaaagtgccctcatttgtggcccaagcctggtctcctcccaaaatactacacatccaactcctggagatttcagttacttacctgcatgtgttgtacaataccagatcactcaaaaaggtgtgtcaaagattttacctgggatatgacaagcaaggtttctggtgcctatttattcattcagtgagacacagagtggagccctcagttttatggatcccaattcatttcatctactacagggtgaggtgcttgcccccatgtgggtgtggcagttacagggcccaggtgagctgaagacaaaccactgtacatatatatgccttatgtaattattttctttttgtaattagtaataaaacccagcatgtacaaaagtaccatagaacagaactgctaaatactgtacatagatgtatcattaatgtaggtttagatatataactttagaaataagaagcaaaaaaaaaaagaaagaaagaaagattcctaacatgcagtaggcatttctgttttgatgtctgtgttttccaggttattttgatccagttgacggctggcccttcagtgcatggcctttgtttgtgtctcagactggcagacgttagggtacctcactgttcccacacggatcctttcattgaatccaacaagccataggtctgggggaaattgagaggtctggtagatggcaaaacccaccaccaatatgctgatatactgtgaaatgttacaaaacagatgtctttttttaaaagataacaagggcctcactaactggcctggaggagggggaataccaggaaggaaatattctctagcctgtcaccaaaggtatgtttttacttttcacatgagctcttgccctttgtagtacaataatttaggaaacttttctgcaaaaccattgattctccagctgtagtttctctacactcttacaatgagacatggtaagttagcagaagatggtttgggtctaaagccgtgaaattcacaaaggcatgtagtgagtggcatgcattataatcatcgacctctcactttgactctatctggctttctgagaatgacatctcgcctgtccctggggcttatccatcagcatttcttgcattgtgatcttttattattttgaaatgaccagagttcagtattcaaagattagatcaacaatcttgatgattgtctaagaaatgtctctagagtatgccacaggctagaaatcaaatccagtgtctgtcaatcaaaagaaaacaaataaaaaaattccagccttaattcactttaatctgcaaaaaggaaagaagggaggaagggagggaggaaggaaggaaggaaggaagggtatttgtactggaaatctgaattttaaaatgaaaaaaataaggaaacaaatcttagatcaaacctccggggcaggtggagattttgcactgttacagatctttcacattcactttgcatttataagctgtttgttctttaacacagttgcccatcataaatattcattgaatggatccaagtttattttcagctcctacagctgtgctcagtttgaggctctgcaccatggaggtcaaagagatcaaactagctgtccctctttgtttcccttgccttccctgacctgatcgcacaggcctttggtgtagtctggggaccttgtctactaaaaaagaagtcccaggataaggaaagtggctcctaaatataacctcggggcctctcttctcccatctcagagaccttggatcaggacaactgcctcttggcactgactttaaggaaaacaaaactgttggctatagccctttcctgtttgccagcatttccttttttgcattgaatctctgttgaatcatttctttatttcgcacactctaagaaggaggtggtggtccgggaggaggaagctcgatacactccccttgaggctgcggggaggagccatggcttgacctctctgcagcctaatgaagggcactcttggcttggggagctcccctgcaaccttgccagggtcgcagggcaggccatggcaggcacaaaacaagatggaataggggcggcaaaatgtcttctaatttagctcttgaagactcactgggcctttttaattccattgctaaggtttaaaggacagcgcacacccccgtgtctggttggaagagcaagcagctcagggcctcatccctgcttgcctgccctttagcacaactgaacgaagagccttgacaacacgttggccacgtgcacctgtcagttctgtgtctgtgacgggcacccagatgtgaggtctctccctgtttctcactgtctttgttgtcaatgtagttggagacagaacttgaaccaaatctcgtttttgtaatgtgagcctctgaatctttacatggggatgctcctgaagaaccttttactagaatgtccctatcaaacatgtctatttttctacagttgttaacacagtttaacagtgtattttgtgtcaactgttaaaatttggaactgaaagttcattgagactgattttctaagcagcgagtagtgagtgaatggtgttttccattaagacagctcaacaaaattgaccccacaatttccactcattctattccgcaatatccagtcctcattccctcagtcactccattagcaaaccaagtgcaatgagaattttttaaaagtctcttttaatacaacagtatccataactaatgaagatcactctcaactagatcctttggtctgtttggttaatgtatttgagtcatttttccataaagcatggtgggatccgtgagccagataagaatttggaatttaagggttatggtttgccacagttgaccccaatttgacagaacaaagtgctcctggatggaagggcaggttcagctgcaagcatgaccccccaccacaaggctgctgagttcctcggattctcacctccacccaccccaacgtgctctccaactggaagagcacccattcatttataaatcaactttatggaaccaataaaatcatttctgttttagctgtcccctgggtaagctatactcttttacattaacatagcaaatgtcaacttttctgttccttcaaacatggccttccagcctggttgttccagcatatatcccctctatgtccatgaggcagaactctctcttcccccactccgttcttccatctatccccatcctttgctgtttccctggttctccagttccaattctattgttttagttcagtaccttatgttccctaacagaaatccagctgcaaatgtcaacctatttcttaagcacaattttctcttgcaggtctaaccaagctagggctctgaaatgtctatttttcactgcactccaatttaaaaattattcatgacttcatttaatagtctaaattttgaattctccagagcaacattcttatgctttccatccctacattttcttacatttcagttttcttacttttttcccctttgcttttttatttagatttaagccagtgtctttgggatatttagaaactgcttacaaaggtgggaactggtggacagagaaagggggcataagaatgctattagaaaactacctgaactcaccagaagaatgggaaatcatttgatttgctgagagaatacaattaaaatactcatagtaaatcatttccaaaacagtttgctaatagtctggctactcttcagtctttctttccttgacttgggtgatactctgtatgatttaaaaatgtcaggaaggtagttgaaagttcagtgtcctctatatattgtaaacattatcttcaaggatgatttcctttcaatggatggctttaacattgaaaaacataggtaacatatacataatagatgattcattgatattactttacaatacactaaaataacattatcttgtttctgaactttatggccaaccggtatctaagaaaatgttagcctttaatttaaaattgagtaaagcacgcctcttcctaatatttctgcctttaatgtcttgagtgctttagatgcagagtgtcatctagaagtcaaaattctgtcagaaggctgctaagagattttgataaatcacagaatatataataataacccaacaatattttacccaacatggtgtggtgtttgagagcattaagagcacttgtacaaattatcttatttcattctaattcaccatgagaggttgagtattataatttacattttatagagggaaaactagggtttgggcaaattggccaagtttaaaggccagtgaatcatagctccttgtctcaaatccaggtcacagggccctaagctgtgggctatttttactacaaaaaatttcagcaaaccaaatctgctaaaaaaaaaaaaatctggcctgctgcctgttattgtaccacttgtgagctaagagcaatttttacattttttaataattgggggaaaaaaaagaaaagaagaatattttgagacatgtgaaaatcatcctaaattcaaatttcaatgtccacaaacaaagttttattggaacacagccacagccatttgtctgtgtattgcctatggctgcttccacatgcactcacagagctgagtaattacaacagagaccgtgtggccagcaaagattgaaatatttactatctggccctgtataaaaaaagtttgctgacccctgtactgtactgttaagtactattggtactattaagtactagtaatagtactattaataatagtatgtaagagtactaagtactatgaaatattgtactgtactcttaagagagtcctaggcaatatagaagaatgactttttttctagcataaattattgaagtcactcataagtctgttcaaaataacataactcttttttttcggttgtcaaagagacaactgcttcacaagacttagagagcccagtcattcagttagggtctcaaaggaagaatccttccttttcatgccattcctccagagtggcaaatagagtcaacagccagccaggatctagcggtcaactcagaaagtggatacagtaaaattactccttaatgaactacagagaaatgggcattcccagcccagccgctgaaatattgcttcagtggcaccctcaggcgttggatgatgtacatagctcaggctgccagtctctgctcagcaaagcagcccagacctgcagtggttgccacacatcaaacccgcctcgctcctccacatggcttctctcttaggctctcttggaggagagttaaataggtggcccagatgtctccctctgttttcttgctagttttctctagcctacagtttacaactgatcaaggtgatgaacgtgaacctggaactagctcatgtttaattgcgctagtttttgctctctctagccactaagctagaagtttaatgtgtaattaaagaactaaatgcttcttatggaaaaccaaaaggtcctttgaaaagagctcagggagacacggaagtatagtaaagggttgttggatttcttgcgctttctgagtctgaagcaaagacaaagattggtaattacagacataatggatggaaaaagtccagaccttggggtttttagatgagtcaatattaaatggcattctttgtgtcactaagctgaactcccttgtcttctaaggaagcatttctaatgccagaggtagtcagccaagctaggttccttatctttttagttctatggaaaaacatatcaagttctcttatgagtgctttcctggaaatcagatgagaaagaaaaaaaagtaacaatgtaacaaatcattgtgatgttgttatattgtcgacagataaaggatggatttgatcctgcgtctgaaactaagtaggtaatggtatctacaatatagatcatgcaaaaagcttgtgacccttcaactgcatggaagagtgggaggaaacaactaagtgggaggaaacaaatctcaaagttcaacaccataaaacttaaataaatgtaaaaggagtcaaacttttacttggcctcattgccttggtaaaagaaagcttcatgtatccacctaattcaataagagagtcctaggaaaaggaaggcaaaatactttaaaggcacacaaaaatatttcactggggtggtcaacatgattaagtgatggagattagatttatcactgatgaaaacagtatttatagagttatttttagacactataccccctagatgcaaatcccaacatgcactgtggttggccggagaattgtggccacatagtaaacagatcttgatttcagagaatgaaatgttcctaccgactttgtgtaattgcccatttcaagattaaggctcagtgcccattgttttaacaccgatcatcaatactgtgatatcaactaagccaatctttataagaatatgaagggctgtttttctcaggcaatgtaaatatctgctaccaacaagcactagtgaaataaacatgtaatcatcatcgtttctaaaactctgatagaaatcacaaaacattcaagcaaaagggcaaggtcttccaggagcctaggagcagacttttggctacaaagagcctagtccaggctgaatgccttatggagtatgtcagtcttgggtcttatcactaaacacaactagtagaactcgatcaactggagtgcagagatcagagtttcggtcagccgtgcattacccaaacctctgggtcttcagccagtcttcttagaagaggggaaggagcactgtcctcagatccggccatcacgggcatcgccctgacatcatctctcagcattgctgactgtgggcatgggtatgagaaataccctcccgtagctcagacttgggcagaacaaaatcctcagccatgcccacccactgaggtctctctaggggagcttctccctgcagggtctggctcttgcccatctggacaatgaccccctagaagtatcttccgggggaccctgtatctttcaagcttaacttgccccacacccttgaccccacagagcacctccctgggtcaggaatgatgactaaattaagacctttagcatctgctaagcacaggggtgccctcccatgtgaaagtccaagtaaaataaatggagtcagggtaaggaaatccccaaaagttctgattttctcatggtgatgatctcagtgcttttctttttcatgacatatctaattctcttttctctaggaagtctcacgttttggtatcacgatgccgtgggcacagactcagtcatcgggccaatggcagaactctctccagatagtctgacctggtccctctttttgagtaaggctgggagtttggtttgtttgagccaccccacaaccaatagaatcccaccctggctaagaaatctcacaaggccgggtgctgtggctcacacctgtaatctcagcactttgggaggccaaggtggcagatcacctgaggccaggagtttgagaccagcctggccaatatggtaataccccgcctctactaaaaatatgaaaaagttagctgggcatggtagttcctgcctgtacacccagctactctggaggctgaggcacaagaatagcttaaacttgggagggggaggttgcagtaagctgagatcatgccactgcactccagcctgggccacggagcgagactcagtctcaaaaaaagaaagaaaagaaggaaggaaggaaggaaggaaggaaggaaggaaggaaggaaggaaggaaaaaagataaagaaagaaggaaggaaggaaggaaagaaagaaggaaggaaggaagaaggaaagaaagaaagaaaagaaagaaagaaaaagaaagaaaagaaaagaaaagaaaagaaaagaaagaaagaaagaaagaaagaaagaaagaaagaaagaaagagaaaagaaagagaaagaaagaaagagaaaagaaatcgcacatccccacctctatcagggtcaccaaatgaaggcatcaatttcaagtcccgttattatctgcaaggaactctgcattgcagcacttacagacacaacttatgctgtctcctggtgcccacacagctttcgggtgatggcagattgtcagccaaccattccccccagctgctctctcttaatttgctccctcatctcaccacgaaaacttcacttttcctggcacccccgttggaaggttaatatcatttttgagcatccacaatccagcaacctattattggggttagtcctattccttaccacttaatagccaccaccaattttaaccgagcgtatatgttcagagtctaaccatatatatatatatatatatatatatgtacattttgttcctgcttcataattgcccagagagtctatgagtgatggttgggcgtatacatggtctcagcccggtaactgacgagagcagcataaagttaggtcttgtgctgaaaggacagctggactggtccagtgggatcttcttgtcctttgcagcatgccattaggggaccagcttgccaaagaagctcctgaacatctttattcagcccagtgcttcctcgtcttaaccaagagccacacagagacaacagtgaactcacaagttcataggattccaaaatgattgactccccaagtgtctgcctgtgttggcaaagtgctctttcctttcccactgtctgcacagactgtactctggggaaactcccagcacttgtgggtgcctggttaccgaggatgtgcttggctgccatggtaactcccagcctctcagtgtggaccactctcccgcaggctcgaggagacctggcagaggccccatggggcggaggctccctagggctgctccacctgcagacagccttgggagaacccaaggtaatgtggagtaggacccagcacacaggagctccctccgcacgccaggtctggggtattcccatcctttcttcctaagatgggatgcacttaggtggccaaattgcttcttaaaaggctcttcttcaagccatcatcctcatatcacactcatgcccacactccagtcacatttgcctttaaaaaattttcaaaattatttttgtattatcccatgtaacagatgtccaaagagttgccattttcttaacactaaataaattctgcctagaagattaagattggtccagaacagggagtgttttaataagcacaaatataaacaaaagcaattttaaaatttacttatggattctttcagaaaacctgatttcaaatcagaaatactcatttttgcccccagagcaaagttccagaatactatttcttcttgaacttgccattttccatctggctttgaacttgagaatagactcccctatattggcataaaaggtaaagtggaatttaccactgaaactttcagagctcaatttagtctggccccatggaccaggcaagaataaactctgctcaccagtaacaattctgcagccaccgtactgaacacaaaccctggagaaattctggacatggtactgcttaagaatgctgggtactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaagaatgctgggaatgtcagtcgagggtctgatttcagaaagaggacattaatattcaaatccctgaaccatgcccacactgtgggagtcaggcctaacaagatcccagggtccatagtttacctggtcagcttgctgtgtctcatggggcattagagggtagatgagaactttccgcaatctcgacaactgcactgtaagaatttcttctgtgtattttctaattctgtgacaacaggcatcaacaaaacatgtggcctgttatcacatggttcctccctgtgtgcaccttcatagagattttttccttttctaaaagaatgaggattcctctgaatgttacactatgcaacaataatgtccccagtccttcataagtaacacagtaacaatataagcaccctctccctacataacacacacacatacacacaaatacacacacagacacatgcatacacacacacatacacacagacacatgcatacacacacatacagagacatgcgcatacacacacacgcatacatgcacatgcatacacacaccaagacatgcatacacacacgcatacacagagacacatgcatacacacacgtgcatacacacacagacatatgcatacacacacgcatacagacatgcatacacacacatgcatacagagacacatgcatacacacacgcatacacacacacgcatacacagagacatgcatacacacatgcatacagagacacatgcatacacgcacacagacacatgcatacacacacacgcagacacagacacatgcatacacacagagatacacgcatactcacacagacacagacacatgcatacgcacacacagatatacacacacacacacacacacacactcttatcctttccaatcagttatgagtgacaccacaaaagtaaatttccagaaatcaaagccttaagattggcgttcctcccctgcatgcactgtggcattattttaaaaatgtaccatacacttccctgaacctgcaggcaacagcctttcttccagtgtttggtaggaaccctggattcagaagaccaggttttgcccccagatgagcaatgtcgtcctgggtatatcatttcactggtcggaaatagcttcctccaccccttttttaaaaacttgataaattttattttttagagcagcattaacttcacagcaaaatagagcagaaattaccaagagctctcatttacccccggcccccgcatgcatggccgcccccacgagtgatatgccaaaccacaatggtacatctgtggaaatggatgagtctacactgagacattactatcaccccagagtccattgtttacaatggtgttgtacattctatggatttgggcaaatgtataaaggcatggatccaccattatagaatcatacaggatagtcccacggccctaaaaatcctctgtgctctcccaattcatcttgtgtcctcccaacccctggcaaccactgatctatttactgtctccatagttttgccttttccagaatggcatataattggactcatgcagtacgcagccttataaaattggcttatttcacttagtaacatgcatttaagtttccctcatatctttttatggcttgagagctcacttttttagcaccaaacactcatccattttctggatgtaccactgtttatttatccattcacctactgaaggacaccttggttgcttccaagtttggtcagttatgaataaagccactataaatatctgtatgcaggtttttgtgtggacataagttttcaattcatttgggtaaatatgatatgttaaagctatatttagtcttgcaagacacagccaaactgccttccaaagtggctgtactgttttgcattccactagcgatgaatgagggttcccgttgctccatatcttcaccagcatttagtgttgtcaatgatctgcatttgggccattctaaaagatgtacggtggtgtttcattgctgttttaatttgcaattccctaatgacatgatttgggacatatttttatatgcttgttttccatctgtacatcttctttggtgaggtgtctgttcaggtcttttgggcatttttttaaatcgggttgttttcttattgttgatttgttaaagttctttgtaaattttagataataattctttatcagatgtgtcttctgtaaatattttctcccagtccgtggcttgtcttctcattatcttgaccttgtctttttcagagcagacgcttttaattttactgaagttcagcttatcatttacttctttcatgatcatgtctttggtgttctatctaaaaatctattgccatatccaaggtcatctaagttttctcttatatgttaccttctaggagttgtatagttttgcattttacattagatctgtgaccgattttgagttaatttttgtgaaaagtgtttgttaggtctgtatttagactcttttttttttttttttttttgcctgtggatgtgcaaatgtgcagctatttcaacaccgtttgttgaaaagaccctctttgccgcactgttttgcctgtgctcctttgccaaggatcagttaactatatttgtgtgggtctgtttctcagctctccattctgttccactgatctatttgtctattccttcaccaacaccacatcgtcttgagtactgtagctttctttctccatataaactgcagactcagttttttggtaccaacaaaataacttgctgagatttttattgggattgtatttaatctacagaggaagctgggaagtgacatcttgacaatattgagtccctccatgaaatggaatatctctgtatttacttagttcttctttgatatcattcaccagttttgtagttttcctcatgtagatcttatacatattgttagatttataccttaagtacttcatttcaagggatactaatttaaataatcatgtgcttttaatttcaaatttcacttattcattgccggtatataggaaaacaattgactttgtatattaactttgaatcctaaaatcttgctataatcccttattagttccaggaaggttctggggcttgtttttgttttgttttttggtcagttatttcagattttctacatagatgatcatgtcatctgtaaacaaagacaaagttttatttcttctttcttcccaatctatatatttttatttcctttccttgtcttattgcatcagccaggacttccagtatcatgttgaaaagcagtagtgatggggacaccttttttttcctgatcttagtgagacagcttcaggtttctcaccatcacgccatttagtatgatgttagctgtaaggttttttttttagatattgtttatcaggttgaggggcttctcctctattcctgctttactgagtgtttttatcatgaaagactgtttggatttttctgcatctgttgatatgatcatgcaatttttcttcttttgcctgttgatattcattacattagttgatctttgaatgttgaaccagccttatatacctaggacaaattccacctggtcatggtgtttaattattttcatatattgttggacttgatttgctaatattttgttgaggatttctgcatctatgcttatgacaggtattggtctgtagttttcttgtaatgtctttgtctggttttggtattaaggtgatgctggattcatagaatgagttagcaagtgttctctctgcttctagcttttgaaagagattgtagataatcagtatcatttcttccttaagtctttggtagaattcaccagtgaacccatctgggccaagtgctttctggttggggaggttactaaccattgattcaaattatttaacagagatatacctattcagattgtctatttgctcttgtgtgagttttgacaaattctatttttcaaggaattggttcatttcatctacattatcaaatttgtgggtataaagtcattcataaaattccttcattatcttttattatccttttaacctccatgggattgctagtaacgtccccgctctcatttctgatagtagtaatttgtgttctttctctttttttcttagttagcatgccttgagacttatggagcttattgatcttttcaaagaatcaactttgtttctatttattttattgatttcctattttcaatttcgtgaatttttaatctaattttaattatttcttctcattggcttactttgggtttaatttgctctttttttctacttttttaaaatggaaacttaaatgattgatttcagatcttcttttgtgctatctgcattcaatgttataaatttccctttaagcattgtttttattgcatcccacaaattataataagctatgtttttattttcatttatttcaaaatattttttcacttatcttgagatttcttctttgacccatgatatttacacgtgtgttgtttaatctccaagtattttggcattttccagctacctttctgttactgatttctagcttaattccattgttatctaagagcaaacattgtaggacttgtattccttttttttttttttttttttttaagacagagtctcactctgttgcccaggctggagtagagtggcatgatcttggctcactgcaacctctgcctccggggttcaagcgattctcctgcctcagcctcccaagtagttgggactacaggtgcccaccaccaaacctggctaatttttgtatttttaatagagatggggtttcagcatgttggccaggctggtcttgaactcctgatcccaagtgatctgagaatttctattcttttaaatgtgttaaggtatgttttatgacccagaatgcagtctaacttgatgaacattccatgcaagcttaagcaaaaagactaatctgctgtagtttcctcatctttttcaacaaacatttgaaccccatagtctctgctttaataattctagtatccattccaacctacaccaccatcagttctagactgtacctctacactaaatgaccccagatggttcagctttaagtctcagctgttttcatcatttaactgattcccttgctggcagcagggaaattaactaccagccacacacttgtctccaacagcacccaccgaccacgtcctgctcccctgtcattaccaccactaaacccggtagcagagagatgagctgtgaggtaggtgccttctagataaatgaggtgctactggacatgcactgtggtcttctctgcagtagaaaaatgtccaaggaaggtcagcatcattgatagaaaataaatgtgaggctgcatctcgccagctcatccatgagcaattccttcagctccagcaggctactgacaatttgcttttaacccaaatccagctctaccctccctaaagcatgcacctagggccccagtcagaaaaacaaaacaaaaactaaaccagacaggataattaaggaggcaaaaagcttaaaccataatattttaattaagctgatttattttaaccgtagcactactgctttattttagttatataccagtaatggaaaatagtggccacttttcattattaatcataagataattcattgtatttgtctttcctaataaaatggcattatattaaggcccaaaatgtttactatggcccagtaaaatatagggttgttctgtgagctatttcttaggatagaaaattattccagaaagctattagttcaaaagtctctagcagtgccaaggtttcaatagtctctttaattttgaatctatgcgattgaagataagactgcatctagtttgggggttgcatgtttgtggacattcatgtttctatgtacctggaacttcttattctcaccatcacacagaattttcaagaactagttaagcaaagaaagcaaagcccagcaggtgtcagaattgggtccccaagctgagggtcattagggtgcatgtcagtgtgccaactccaatatccacacctagagaacgcacatcttcccaaaagaaatgaagcacagatgatacttgatcctcaactttgtctccagaaattttttcaggaacttgagttctttatcaaatgctcacatcctacagagaaataaagtgttccattttcaaggttcatgaagctcgtcaatgctgggagcaggcacacacttgtatttttatactcagggatcccaacaggcaactaaaactagacaaggacaaaactccactcaaaatattctgaaagttagctgatgccccatattttattactccaaatgtgtattcacttgcctgagtgctggccatgagcactcagtgaacacttgcagtacagtgagtgatgtccttgacaagttactatgaagactctgagaaaaagtaacatcccccactgtcctcaacaagcctgtaatcccatggctgccagcccttaccatgcaacaacactgcgctaagtgcatcgaaccacacaaaaccctgtgagaaaatactgcttcccacttcacacgtgaagtaactgagtctagttttagaaatacctaaacgaagagggacaggcacaacaaatttgctggaatgtaaagaaagtagatcagtttctgcgtaagcagtaagaaatggcctcatgaggaagaaagggacatttgccctgacatttctcaaagactgcttaggttttggagacagagatccaagggcaggcaagcacaatggttcatgcctgtaattccagcactttgagaggccaaggtgggaggattgcttgagcccaggaattcaagattagcctgtgcaacacagcaagaccccatctctattttaaaaagagagagagagatccaaaagcaaaggcatttcagtttgcaaggccagcatgggagagggtcttaaaacagaaacacacaaggtaagattgggggatggtacctagaccagcctaggatcataggatttgataaaatatgcatttggaaaactggtgctaatttatagagacttagaatttcaggctaaggacaaggactaagaaacgaatagcatgaacagtattattgataaacccatcattgcatcttaaaggctctgaagtctttagtattgaattaaaaaataattttcactggacaaaaccaaaaggtctttacacaactgtcaagcactttgaaatgattcagcaaaaagcagaataaatcactagtggaatttcaatagcatgtagttgtaaaccatcatgtgtccagcaaaatcacaaaacaagagtttattttagaagggacttagggatattaagaaatataacatacaaaataactaaagttttctccaagcaaaaccaatgatcctttagggatgaacagaaagaaaacaagaaatgcttctttcaaaagttgctaccaaggcttctaagatttctttggaataaagtcactaagatttgcttctgaggtcaatcttgccaacttttccaccatgctttttaggaaggaacaccaggtagggctcaagtactggtttggctcctgtcccattttttggtccttttgtaactccctttactcaactccaagtatgtctgtgcacggacaatgagacgaaagcatgctcaatgcgaaagcacaaattatgtattgagaaatcactacaatgccaaatttttttaaaataaaaaaaaaatatatatatatatatatatctttaagaactcgctgtgttagggaaactgtttacatattgaggtgttcctctttttttgactggaacaataaaagaaaaatttgata

SEQ ID NO: 168117 - DNA, 2389 bp, Homo sapiens
  Payload ID: 13068
  Gene Symbol: KCNJ8
  Gene Name: potassium channel, inwardly rectifying subfamily J, member 8
  Uniprot ID: Q15842
  ENST ID: ENST00000240662
  CDS Start-End: 347-1621
cctcctccttccactgaagtggccaagggagttgagctgagcagggggaggggaagatctacacccatcccccttcctctagccctccctgcgtttagattcagttgcaccttttattattttaactcttctccttaggacacgcagcccccaatttgtccctccggcctgggcggcccctggtcccgcgcgccagcatgggagagcgagggacctgcccgcggcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtcatagttattctggaaggagtggttgaaactactggcatcaccacacaagcacgaacctcctacattgctgaggagatccaatggggccaccgctttgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaataaaaagtaacacaccaagtggaggattcatggcttatgcttgtttcatacatgtagaattcgcagtgatatacttaagttatgtgcaggggtgggtatgctcgtttctctcaatttgaaacacaagaattacactaatagtaacaggccttgagcacaaaatttggtcaagaaatgagtctgtttgaaatgcttagttggtgaaacccagatcgctgtgttactaatgatcactctggaaatgcaaatagaataggaggggaaaaaacaaaatcatgttaatgcgttttgtacatcagccttctcctgtctccatgataactgcatttggtaggaagcctgaggcaaaaactgcttaagtggatctgtttgtaagtggattcagttcattcgctttgtctgtcggtgactcctgaaggtttcctggtccatctcattgcggcctgttgggcagagctggacaaggtgtctttgaaggaaagctaagtcttgtctcatttaggactgggttccccacagtgacagtcacttccttcagcatctcacttcttcttctagaatccccacagggaaatactgtattgaatattttattaaaacattttctttgta

SEQ ID NO: 168118 - DNA, 507 bp, Homo sapiens
  Payload ID: 13068
  Gene Symbol: KCNJ8
  Gene Name: potassium channel, inwardly rectifying subfamily J, member 8
  ENST ID: ENST00000537950
  CDS Start-End: 166-507
aagaagctgcaacatttcagaaagcaaccaattactgaggaccgaatgacctggccttatcagcgctgaagtgttaacggccgtccctgtttggggaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggt

SEQ ID NO: 168119 - DNA, 4170 bp, Homo sapiens
  Payload ID: 13069
  Gene Symbol: KCNJ9
  Gene Name: potassium channel, inwardly rectifying subfamily J, member 9
  Uniprot ID: Q92806
  ENST ID: ENST00000368088
  CDS Start-End: 243-1424
acatttaggagaaacagcggtgtctgcggctcccacccttcggggggcccgtggggggggcggtgtcaggggcatggacgccaccccccaggggtctctgctgccggctactctcctctccacgtgctcccctccaggacccccgacgccgcctaggcgcccagcgacgcgcggcaggtggcagcagctcgggcccccgccgcactccaggcgcccgcagcgctcgccctgacgcggccgccatggcgcaggagaacgcggccttctcgcccgggcaggaggagccgccgcggcgccgcggccgccagcgctacgtggagaaggatggccggtgcaacgtgcagcagggcaacgtgcgcgagacataccgctacctgacggacctgttcaccacgctggtggacctgcagtggcgcctcagcctgttgttcttcgtcctggcctacgcgctcacctggctcttcttcggcgccatctggtggctgatcgcctacggccgcggcgacctggagcacctggaggacaccgcgtggacgccgtgcgtcaacaacctcaacggcttcgtggccgccttcctcttctccatcgagaccgagaccaccatcggctacgggcaccgcgtcatcaccgaccagtgccccgagggcatcgtgctgctgctgctgcaggccatcctgggctccatggtgaacgccttcatggtgggctgcatgttcgtcaagatctcgcagcccaacaagcgcgcagccacgctcgtcttctcctcgcacgccgtggtgtcgctgcgcgacgggcgcctctgcctcatgttccgcgtgggcgacttgcgctcctcacacatagtggaggcctccatccgcgccaagctcatccgctcgcgccagacgctggagggcgagttcatcccgctgcaccagaccgacctcagcgtgggcttcgacacgggagacgaccgcctcttcctcgtctcgccgctggttatcagccacgagatcgacgccgccagccccttctgggaggcgtcgcgccgtgccctcgagagggacgacttcgagatcgtcgttatcctcgagggcatggtggaagccacgggaatgacatgccaagctcggagctcctacctggtagacgaggtgctgtggggccaccgcttcacgtcagtgctgactctggaggacggcttctacgaagtggactatgccagctttcacgagacttttgaggtgcccacaccttcgtgcagtgctcgagagctggcagaggctgccgcccgccttgatgcccatctctactggtccatccccagccggctggatgagaaggtggaggaggagggggcgggggagggggcgggtggggaagctggggctgacaaggagcagaatggctgcctgccacccccagagagtgagtccaaggtgtgaccagcttcctccagacccctgtggcagaccgggggccagacacagatacatggggaactgcatatcggaggtggtggaggaggaggaggaggaggaaggcaaagcccctggaaatgtgctaaagttggaaagtccccgtcccccagaacctcaagtctagaaaccagtatggaagggaggggtcctgatttcagggaaatggagggtggggccgggtgaaaatgccagtctgtgtttgaccttcacatttgttcatgagtggatggatggacagaatgatggacttttgggggttggatgggaagatggtagcagataaagacagctgacagatacatagatggaccagtagacaactggtccactcagggctgccactaacctgtagaacacccctgtgcaaattttaaaaaggaacccttttcctccagacagatacagccccaaaccagggtgcatggcttggggagcagagtataggatggattgcagtccccagtcacctcttctgccagcctccccacatatggcacaactgtctaatgacacggtaggccaagctgaagtgaaggagaaaggagccggaccaagatgggcacatgaggagggtgccctcctagctccaccctcaccaggatgaaggcgtgcaaggggctcagcaaggtgtgaatgaccttagtccgcaagttcagggaagcaggcagagcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactgattgggtgccatgtggagtggacattcaaaaacctggttcctgtcctcaaaataaggggcacctgggaaaacagaggaatctacctgtggtgactgaacgagggataattcaaactgacaacctgtgcagtcccgtggagggtaggggagtgtgggtgatcagaaggctggggccagtgtaaggcatagggaatatgtaagtcaggagttagaaatctccagtgtgcgttggaatcacctggagggcttggtaaaacacagatttttgggctccactccaagggtttctgacccaagaggtggggaccaaaaccatgcattcctaagaagtccccaggtcatgctgctgttgctggactgaggaccacactttgagaacctgtgctctaagtgaatacttggaagtcgtttcaggacatggggcatagaaactgaggagtagctgagaggaagatgaagagaagctgagaagaagctgaggatcctcacaggagcagacagagaaatgtgaagggtggggttttatgtgtgggaaagggacccgaagcccaggctgaagagtttaactttgggcccagaaactcaaccatcaatggaaacagggcagtgacaagtggagggggtgtctggaagctgagcaggcccgacagagagatgaagccatcagaaggacttgagggggctcctggggaggtcggggggaggtggagcaggaagagttttaggggcaaaggacagaaccccttgtaggactggaggcaagattgaatgtgggagaaaatcggagagaagcgataggagttagaacatctggatgtgtctgcagcctgctgtcagcccaattgggccagggggtcccaaagacgcatattctcaccccacctccacctgcttcctgatcacatcccagtcaccagcggcagcttcctggatagtgagggagaacaactgcaagttgagagaggcagaggggtggaagggacctgaagctggcctggagaaaagcataggcccaggagagcctgccctgggacagcgcctgtctcccacacagcagcactggcccagcaaggacctcctcccttggccctggccacatcccactcctgccctttcataagccccctggggaaagcactccagtcttctctgttccaggctgggcagatagggtcctatggggcacagccagggtcctatgggcatagccagggccctatgggtcctctggaagcaagaaagggggccatggaagcagcccagacagctggggttcactcagagaggacccaagtcccagtcccttcctttcagtcaaaacacggatatctttgcctcaggtcacagggccactggggccctgtcatcaaagatgagattcctgaagcctggcattgactggtcccctaagaacagatgttgggatggagaatggggattcatttgggtttcagtaaaacaggggggtctggacaagagcgggtgggctacttggtatccacacacacgcactcacacaggagccaacccattgcagctgaacaagcagagaaactcagtctggaaaggcccctcctgcctgctgaagtcactgagaccctgccacacctctcctcgccactgtcaccactcagggcaccactgtacagtgcaacaagtcaggagacctaggtcctactcctgacacttgctaattagctctatgactctgggcaaatcgcatatctgggcctcagtttcctcatctgtaaaaatgacagcaaactcgtaatgctcaataaatgtttaaataacaactgaa

SEQ ID NO: 168120 - DNA, 5245 bp, Homo sapiens
  Payload ID: 13070
  Gene Symbol: KCNT1
  Gene Name: potassium channel, sodium activated subfamily T, member 1
  ENST ID: ENST00000263604
  CDS Start-End: 117-3788
ggccgttccactgcgcggcggcgtggggagggcgcggcgcgagctgagatggttccgcccggcgccgcccccgctgcccgccgcccgccgcccgccgcgccgagcgctcccgcaggatggcgcgggccaagctgccgcgctcgccgtccgagggcaaggcgggcccggggggcgccccagccggcgccgcagcccccgaggagcctcacgggctcagcccgctgctgccggcccgcggcgggggctccgtgggcagcgacgtgggccagagggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgaggacgtagcaaatttaacagccagtgatgtcatgaatcgggtaaacctgggatatttgcaagacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctgagccagccctgcacggagctcaggccaccaagcccggggtcctcaggaaggacgtggaggagcgtgtgaggacacggtggcactagcgtgaccctggggatggcacactctactcaccatggctcctgggactccaccctggaaaggagcccctcatgcggggggagggccagctcacccctgggcacctgcaggctagtgaggagagttttttaacctatttttacacgtcgatgcagtccacttctctttacacagatgtaccgcaactcgtgaccagggctggctgggagggcaacgcagggactggacgccctacagggccgagcccaggctgtgctggagggtggggctggggtgcatggggaggggagcagaacccagaacccaggagccccgcgtgggccacacccaactcagagccggcctgagcgttcacggccaggcagcctcgcttccttgcagccaagggctgggggccagggctgctgttctgcactctggggtgggtgagggggaccctgggctgtttgctgtcccaagccccttctggaagttagaagcagcaaagggcccggggaagccgggcatgtgagaggggtgcgtccccaggtcccccagagggccctgtcgccgaggacctttctgaaggaagcagaagacgccatttcctctacttcacactgaactgtcccagccactgcatctagggggcattgggcggaagatggtgcatttccatggaccattttacacttaccttttaaagcaaagcctcattttctaaacccctgacttgtgaagcacaattcagcctccgggctgggccacgtggagagagaggatcttctcagcaaggcgagatcccgggcggcggctgacatcaggagcgccaccctgcgtcctttgctgctggttccttactggtttgtacggtcagcgctggaaacttctattaaatggatgcattctggaggcatgaagttacaagtcaagtcgccctgctcgtgtttccaaggctctcacccctcccagccaccccactttaagggttacaaacacctgctggggtccccaccccaaccccataggcaagcccccattccccagccaggccaggacagtccttccaaaactcgggaaccaaattgtatttggctactggtgactggatcctggtagccaggaaacctgcctggtggtgggggtcccagagtccaggagggctgtctggtgagctgcccatcagcctcacccctgcagccaggcatgtccctggggtgggcacagagaccccaggctctgcccgcagtggcacagaactcatctgaggccagtggctgctggggatcccctacactgggggtcagggctgccccaggtggggatgtgtgtgcacctcaccacgttcacttcagggtaccccaagaggctgaaggggaaggaccaaaaggccga

SEQ ID NO: 168121 - DNA, 4717 bp, Homo sapiens
  Payload ID: 13070
  Gene Symbol: KCNT1
  Gene Name: potassium channel, sodium activated subfamily T, member 1
  Uniprot ID: Q5JUK3
  ENST ID: ENST00000371757
  CDS Start-End: 68-3775
cgcgagggaagaaggtggcggctcccactcgcttctccctcgggtcgggtccgagctgccaggccgcatgccactccctgacggggcgcggaccccggggggcgtctgccgggaggcgcgcggcgggggctacaccaaccggaccttcgagtttgacgacggccaatgcgcccccaggcggccctgcgcgggggacggcgcgctcctggacaccgccggcttcaagatgagcgacctggactccgaggtgctgcccttgccgccgcgctaccgcttccgggacctgctgctgggcgacccgtccttccagaacgacgacagggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctgagccagccctgcacggagctcaggccaccaagcccggggtcctcaggaaggacgtggaggagcgtgtgaggacacggtggcactagcgtgaccctggggatggcacactctactcaccatggctcctgggactccaccctggaaaggagcccctcatgcggggggagggccagctcacccctgggcacctgcaggctagtgaggagagttttttaacctatttttacacgtcgatgcagtccacttctctttacacagatgtaccgcaactcgtgaccagggctggctgggagggcaacgcagggactggacgccctacagggccgagcccaggctgtgctggagggtggggctggggtgcatggggaggggagcagaacccagaacccaggagccccgcgtgggccacacccaactcagagccggcctgagcgttcacggccaggcagcctcgcttccttgcagccaagggctgggggccagggctgctgttctgcactctggggtgggtgagggggaccctgggctgtttgctgtcccaagccccttctggaagttagaagcagcaaagggcccggggaagccgggcatgtgagaggggtgcgtccccaggtcccccagagggccctgtcgccgaggacctttctgaaggaagcagaagacgccatttcctctacttcacactgaactgtcccagccactgcatctagggggcattgggcggaagatggtgcatttccatggaccattttacacttaccttttaaagcaaagcctcattttctaaacccctgacttgtgaagcacaattcagcctccgggctgggccacgtggagagagaggatcttctcagcaaggcgagatcccgggcggcggctgacatcaggagcgccaccctgcgtcctttgctgctggttccttactggtttgtacggtcagcgc

SEQ ID NO: 168122 - DNA, 3760 bp, Homo sapiens
  Payload ID: 13070
  Gene Symbol: KCNT1
  Gene Name: potassium channel, sodium activated subfamily T, member 1
  ENST ID: ENST00000486577
  CDS Start-End: 107-3760
gcgcgcgtccgcgagggcgcccgacgcgggctgaggggcgctggcgtgtgcccgcaggcggccctgcgcgggggacggcgcgctcctggacaccgccggcttcaagatgagcgacctggactccgaggtgctgcccttgccgccgcgctaccgcttccgggacctgctgctgggcgacccgtccttccagaacgacgacaggcttcctgtagaagatttcagcctggactcctccctgtctcaggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgaggacgtagcaaatttaacagccagtgatgtcatgaatcgggtaaacctgggatatttgcaagacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctga

SEQ ID NO: 168123 - DNA, 3845 bp, Homo sapiens
  Payload ID: 13070
  Gene Symbol: KCNT1
  Gene Name: potassium channel, sodium activated subfamily T, member 1
  Uniprot ID: Q5JUK3
  ENST ID: ENST00000487664
  CDS Start-End: 75-3845
agggcaacgcgagggaagaaggtggcggctcccactcgcttctccctcgggtcgggtccgagctgccaggccgcatgccactccctgacggggcgcggaccccggggggcgtctgccgggaggcgcgcggcgggggctacaccaaccggaccttcgagtttgacgacggccaatgcgcccccaggcggccctgcgcgggggacggcgcgctcctggacaccgccggcttcaagatgagcgacctggactccgaggtgctgcccttgccgccgcgctaccgcttccgggacctgctgctgggcgacccgtccttccagaacgacgacagggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgaggacgtagcaaatttaacagccagtgatgtcatgaatcgggtaaacctgggatatttgcaagacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctga

SEQ ID NO: 168124 - DNA, 3708 bp, Homo sapiens
  Payload ID: 13070
  Gene Symbol: KCNT1
  Gene Name: potassium channel, sodium activated subfamily T, member 1
  ENST ID: ENST00000490355
  CDS Start-End: 1-3708
atggcgcgggccaagctgccgcgctcgccgtccgagggcaaggcgggcccggggggcgccccagccggcgccgcagcccccgaggagcctcacgggctcagcccgctgctgccggcccgcggcgggggctccgtgggcagcgacgtgggccagaggcttcctgtagaagatttcagcctggactcctccctgtctcaggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgaggacgtagcaaatttaacagccagtgatgtcatgaatcgggtaaacctgggatatttgcaagacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctga

SEQ ID NO: 168125 - DNA, 4738 bp, Homo sapiens
  Payload ID: 13070
  Gene Symbol: KCNT1
  Gene Name: potassium channel, sodium activated subfamily T, member 1
  ENST ID: ENST00000460750
  CDS Start-End: 47-415
ctcccactcgcttctccctcgggtcgggtccgagctgccaggccgcatgccactccctgacggggcgcggaccccggggggcgtctgccgggaggcgcgcggcgggggctacaccaaccggaccttcgagtttgacgacggccaatgcgcccccaggcggccctgcgcgggggacggcgcgctcctggacaccgccggcttcaagatgagcgacctggactccgaggtgctgcccttgccgccgcgctaccgcttccgggacctgctgctgggcgacccgtccttccagaacgacgacagggtccaggtggagttctacgtcaacgagaacaccttcaaggagcggctcaagctgttcttcatcaaaaaccaaagatcgagtcagaagagggcagaacccactaggagagtttgagaaggagaactgggccctgactgactctcaagctactttcctagctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgaggacgtagcaaatttaacagccagtgatgtcatgaatcgggtaaacctgggatatttgcaagacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctgagccagccctgcacggagctcaggccaccaagcccggggtcctcaggaaggacgtggaggagcgtgtgaggacacggtggcactagcgtgaccctggggatggcacactctactcaccatggctcctgggactccaccctggaaaggagcccctcatgcggggggagggccagctcacccctgggcacctgcaggctagtgaggagagttttttaacctatttttacacgtcgatgcagtccacttctctttacacagatgtaccgcaactcgtgaccagggctggctgggagggcaacgcagggactggacgccctacagggccgagcccaggctgtgctggagggtggggctggggtgcatggggaggggagcagaacccagaacccaggagccccgcgtgggccacacccaactcagagccggcctgagcgttcacggccaggcagcctcgcttccttgcagccaagggctgggggccagggctgctgttctgcactctggggtgggtgagggggaccctgggctgtttgctgtcccaagccccttctggaagttagaagcagcaaagggcccggggaagccgggcatgtgagaggggtgcgtccccaggtcccccagagggccctgtcgccgaggacctttctgaaggaagcagaagacgccatttcctctacttcacactgaactgtcccagccactgcatctagggggcattgggcggaagatggtgcatttccatggaccattttacacttaccttttaaagcaaagcctcattttctaaacccctgacttgtgaagcacaattcagcctccgggctgggccacgtggagagagaggatcttctcagcaaggcgagatcccgggcggcggctgacatcaggagcgccaccctgcgtcctttgctgctggttccttactggtttgtacggtcagcgc

SEQ ID NO: 168126 - DNA, 3696 bp, Homo sapiens
  Payload ID: 13070
  Gene Symbol: KCNT1
  Gene Name: potassium channel, sodium activated subfamily T, member 1
  Uniprot ID: Q5JUK3
  ENST ID: ENST00000488444
  CDS Start-End: 4-3696
aggatggcgcgggccaagctgccgcgctcgccgtccgagggcaaggcgggcccggggggcgccccagccggcgccgcagcccccgaggagcctcacgggctcagcccgctgctgccggcccgcggcgggggctccgtgggcagcgacgtgggccagaggcttcctgtagaagatttcagcctggactcctccctgtctcaggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgaggacgtagcaaatttaacagccagtgatgtcatgaatcgggtaaacctgggatatttgcaagacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctga

SEQ ID NO: 168127 - DNA, 3678 bp, Homo sapiens
  Payload ID: 13070
  Gene Symbol: KCNT1
  Gene Name: potassium channel, sodium activated subfamily T, member 1
  ENST ID: ENST00000491806
  CDS Start-End: 19-3669
gccgagcgctcccgcaggatggcgcgggccaagctgccgcgctcgccgtccgagggcaaggcgggcccggggggcgccccagccggcgccgcagcccccgaggagcctcacgggctcagcccgctgctgccggcccgcggcgggggctccgtgggcagcgacgtgggccagaggcttcctgtagaagatttcagcctggactcctccctgtctcaggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctgagccagccct

SEQ ID NO: 168128 - DNA, 1024 bp, Homo sapiens
  Payload ID: 13070
  Gene Symbol: KCNT1
  Gene Name: potassium channel, sodium activated subfamily T, member 1
  ENST ID: ENST00000473941
  CDS Start-End: 169-1024
cccggtgggtcgcggtggccgcgggctgcgctgcgcgggccgggcctggcgggccgggggctgcgcgcgtccgcgagggcgcccgacgcgggctgaggggcgctggcgtgtgcccgcaggcggccctgcgcgggggacggcgcgctcctggacaccgccggcttcaagatgagcgacctggactccgaggtgctgcccttgccgccgcgctaccgcttccgggacctgctgctgggcgacccgtccttccagaacgacgacagggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccc

SEQ ID NO: 168129 - DNA, 3948 bp, Homo sapiens
  Payload ID: 13070
  Gene Symbol: KCNT1
  Gene Name: potassium channel, sodium activated subfamily T, member 1
  ENST ID: ENST00000631073
  CDS Start-End: 9-3722
cccgcaggatggcgcgggccaagctgccgcgctcgccgtccgagggcaaggcgggcccggggggcgccccagccggcgccgcagcccccgaggagcctcacgggctcagcccgctgctgccggcccgcggcgggggctccgtgggcagcgacgtgggccagaggcttcctgtagaagatttcagcctggactcctccctgtctcaggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgaggacgtagcaaatttaacagccagtgatgtcatgaatcgggtaaacctgggatatttgcaagacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctgagccagccctgcacggagctcaggccaccaagcccggggtcctcaggaaggacgtggaggagcgtgtgaggacacggtggcactagcgtgaccctggggatggcacactctactcaccatggctcctgggactccaccctggaaaggagcccctcatgcggggggagggccagctcacccctgggcacctgcaggctagtgaggagagttttttaacctatttttac

SEQ ID NO: 168130 - DNA, 7057 bp, Homo sapiens
  Payload ID: 13070
  Gene Symbol: KCNT1
  Gene Name: potassium channel, sodium activated subfamily T, member 1
  Uniprot ID: Q5JUK3
  ENST ID: ENST00000628528
  CDS Start-End: 75-3710
agggcaacgcgagggaagaaggtggcggctcccactcgcttctccctcgggtcgggtccgagctgccaggccgcatgccactccctgacggggcgcggaccccggggggcgtctgccgggaggcgcgcggcgggggctacaccaaccggaccttcgagtttgacgacggccaatgcgcccccagggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggggttgcaggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgaggacgtagcaaatttaacagccagtgatgtcatgaatcgggtaaacctgggatatttgcaagacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctgagccagccctgcacggagctcaggccaccaagcccggggtcctcaggaaggacgtggaggagcgtgtgaggacacggtggcactagcgtgaccctggggatggcacactctactcaccatggctcctgggactccaccctggaaaggagcccctcatgcggggggagggccagctcacccctgggcacctgcaggctagtgaggagagttttttaacctatttttacacgtcgatgcagtccacttctctttacacagatgtaccgcaactcgtgaccagggctggctgggagggcaacgcagggactggacgccctacagggccgagcccaggctgtgctggagggtggggctggggtgcatggggaggggagcagaacccagaacccaggagccccgcgtgggccacacccaactcagagccggcctgagcgttcacggccaggcagcctcgcttccttgcagccaagggctgggggccagggctgctgttctgcactctggggtgggtgagggggaccctgggctgtttgctgtcccaagccccttctggaagttagaagcagcaaagggcccggggaagccgggcatgtgagaggggtgcgtccccaggtcccccagagggccctgtcgccgaggacctttctgaaggaagcagaagacgccatttcctctacttcacactgaactgtcccagccactgcatctagggggcattgggcggaagatggtgcatttccatggaccattttacacttaccttttaaagcaaagcctcattttctaaacccctgacttgtgaagcacaattcagcctccgggctgggccacgtggagagagaggatcttctcagcaaggcgagatcccgggcggcggctgacatcaggagcgccaccctgcgtcctttgctgctggttccttactggtttgtacggtcagcgctggaaacttctattaaatggatgcattctggaggcatgaagttacaagtcaagtcgccctgctcgtgtttccaaggctctcacccctcccagccaccccactttaagggttacaaacacctgctggggtccccaccccaaccccataggcaagcccccattccccagccaggccaggacagtccttccaaaactcgggaaccaaattgtatttggctactggtgactggatcctggtagccaggaaacctgcctggtggtgggggtcccagagtccaggagggctgtctggtgagctgcccatcagcctcacccctgcagccaggcatgtccctggggtgggcacagagaccccaggctctgcccgcagtggcacagaactcatctgaggccagtggctgctggggatcccctacactgggggtcagggctgccccaggtggggatgtgtgtgcacctcaccacgttcacttcagggtaccccaagaggctgaaggggaaggaccaaaaggccgaggtgcagcccctccccggtgtcagggcagacaacacagcagctgctggaggggccggccctggccacacagactagctagtcccttactcccggcctgtctggaaccctcctgctcagaaggtgcccactagccctctgtgggggacagagccagacatgggtggtcagggagaggctgtgtggattcaggggaccagaaagtaagtcccaggaccttgatggagcggcagggattgatgttgggctagggtggccagagcctgtcccagcagggctggggtctatcacgttcctgggatccaagcagcgagcacgccctgccccgcagtcaccccgccccgcagtcgccctgcagctggaaggcccaagtctgcctcacctgggtggcctctcatgtcccccacaccctggcccccaggcgaggggggctgcacagcacctgcagggaggagaagggagagaaaagccggtctggctgctgggatgggagggccacagttccagcagtggcaggggaagctgtagcccctggagccccacactggaagagctggcctgcaggaggcaccatgggggagtcgcatgacttattcgggattgacttgcgatgtggatggtgttcccggagtcccctgtggccactccaccaccatgaggccgggaggcatcttagcctttgagcctctctccaggggtgagcggagccccccaaagagggctgaaggcttgctgcccaagaggggctgggtgagcacttggggcctctgagaacatcagtggtccgttccctcctgcacactggtggcaagtggcagcattttttcataatctccagtaatgaggccacttcgggtccagccctggacatccgaggaggaggcgggcagtccctgccccttcactaaccgcagaggatgccagctctaggccccctgctccgcctggagctcatgcgggcagccgtggacacaggtggcacccagcgcccagcggcctgtgaatcctcccgtgggcaaagctgggagccaggggctggaaccaggcaggtcagtgactgtgagatgccagctgccagcccaagaaaagctgcctgcagcatctggaaacttctgtgctctccttggcctctgtgttcttcatctccaggtttagggagcacccgggtgcctctctgcttgtcccgagcccactcaccaacagccccagcttgcacagtcatgacatcaggaaggtgggtccctgctcccagccgtcctcgtccaccatcacttctcccagcctcgtgtcctgctgacccataaaaggtccccctgcaaagtacaccaagtgaagtaggatctgagcaaaggttgagggactgaattccctaagaagtcatcactgcctagaataagcgaaaagaattttttttaatgttttacggtagaattatttgaaacatacaaaatgagtgagacacctgctattttccttattcctgttttttgtttgtttttattttccttatacctaattcatctaacagaaaactgggcagggcgcagtgtctcacacctgtaatcccagcactttgggaggccaaggcaggtggactgcttgagcccaggagttgagtttaagatcagcgtgggcaacatgatgaaccctgactgtatcaaaaagtacaaaaaaaaaaatagctagacgtggtggcatgtgcatacagtcccaggtacccaagaggctgaggaaggaggatcacctgagctggggaggttgaggctgccgtgagctgagatggcaccactgcactccagcctgggtggcagagagagaccctgtctcaaacaaaacaaacaaacaaaaaagaaaaagaaaataaaactgtttgctcaaaatcagaataccaa

SEQ ID NO: 168131 - DNA, 3606 bp, Homo sapiens
  Payload ID: 13070
  Gene Symbol: KCNT1
  Gene Name: potassium channel, sodium activated subfamily T, member 1
  ENST ID: ENST00000630792
  CDS Start-End: 1-3606
atgagcgacctggactccgaggtgctgcccttgccgccgcgctaccgcttccgggacctgctgctgggcgacccgtccttccagaacgacgacagggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcggccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggtggccatggacctgcagggcacagagcaccggcctacgcagagcggcggtgggggcgggggcagcaagctggcactgcccacggagaacggctcgggcagccggcggcccagcatcgcgcccgtcctggaactggccgacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgcggagtggatcagccagcagcgcctcagcctgtaccggcgctctgagcgccaggagctctccgagctggtgaagaaccgcatgaagcacctggggctgcccaccaccggctacgaggacgtagcaaatttaacagccagtgatgtcatgaatcgggtaaacctgggatatttgcaagacgagatgaacgaccaccagaacaccctctcctacgtcctcatcaaccctccgcccgacacgaggctggagcccagtgacattgtctatctcatccgctccgaccccctggctcacgtggccagcagctcccagagccggaagagcagctgcagccacaagctgtcgtcctgcaaccccgagactcgcgacgagacacagctctga

SEQ ID NO: 168132 - DNA, 991 bp, Homo sapiens
  Payload ID: 13070
  Gene Symbol: KCNT1
  Gene Name: potassium channel, sodium activated subfamily T, member 1
  ENST ID: ENST00000631193
  CDS Start-End: 1-534
gacagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacggccggcaatgggctgtacaacttcatcgtgccactgcgggcctactacagatcccgcaaggagctgaaccccatcgtgctgctgctggacaacaagaccgctgtccccacaggcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccg

SEQ ID NO: 168133 - DNA, 4409 bp, Homo sapiens
  Payload ID: 13071
  Gene Symbol: KCNT2
  Gene Name: potassium channel, sodium activated subfamily T, member 2
  Uniprot ID: Q6UVM3
  ENST ID: ENST00000294725
  CDS Start-End: 917-4324
tttttccccgagttcagggaaacacctcccttctttcagaatgtgagaaaaaaatgggattttcctggggctgagagtggggattccctttccagaaacgtgcaattttttcatcccgcccacctggactgaaggcaatcaaagcgagggagctcgtggcatagtggaacactccaagcaccctggcccccctcctcccagagaagggtctggagccccgcaatccgctaattagctcgcccccattggttgtccccaaggcacccccgtgccgtcactgtgctatgctaatgagggggagtctcattggctgggcctccagctccatctccacagggagattgcggggagagccgggttggccgcgtctggggccgaaacccaccgcccccgattcccgccagctcagggctgtgccggatgcaagcccgcccgagggaacagtagccgggaggctgccctctgggaggatctggcaactgcctttaaggaaagtgcttcaccatcaagcggcgctcactcccacccctctcccctctttctaggcaccgcgcgtctttttcggcgaagtaactttttatacccgcctccccctagtcctggggaccagaggcggtgccgagcctgggggcggttccttggcagcgttgattcttgtcagagccagacttttgctcctgggttgggtttgcatcatccccattacaccctcgggaaagaggagccagccccctttcaagccttagcttccggctccaagcggaccccctccccctccctgtccccttccccttctcccatccctctctcggccacagcgtcttgttagtcctctccctgtactccgcaatattttctttctttctccctcctctcctccatttgttgtttgatgtttcccactctttgaggaaggatggttgatttggagagcgaagtgccccctctgcctcccaggtacaggtttcgagatttgctgctaggggaccaaggatggcaaaacgacgacagggtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctgcatttgtgggatccaacatctggaacgaataggaaagaagctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcaagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataacccgccagatatgcattttctggatgcaatctgttggtttccaatggtttactacatggtgggctctattgacaacctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatgga

SEQ ID NO: 168134 - DNA, 5883 bp, Homo sapiens
  Payload ID: 13071
  Gene Symbol: KCNT2
  Gene Name: potassium channel, sodium activated subfamily T, member 2
  Uniprot ID: Q6UVM3
  ENST ID: ENST00000367433
  CDS Start-End: 103-3438
acagcgtcttgttagtcctctccctgtactccgcaatattttctttctttctccctcctctcctccatttgttgtttgatgtttcccactctttgaggaaggatggttgatttggagagcgaagtgccccctctgcctcccaggtacaggtttcgagatttgctgctaggggaccaaggatggcaaaacgacgacagggtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctgcatttgtgggatccaacatctggaacgaataggaaagaagctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcaagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataaccccctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatggacacagaatgctgctgctcctcttaaaaattaaatgtgtcatattatattctttaaacttactgttttacaaaattgagctcatcgtaaatgtctagtcttctcacatagagattaaccaacaaacttgtgtggctgacttttgtgtaagaatcatagtttgctttagaatacaaatctttaagtcattttaacttttttttctgccttacgatataaaaatatttatcttagaatttgagatgttcatagcatgttttattacattgaagaaactaaaacataaatgaaaagaaacactaggttcctgcactttttggtaactttatgtctagcaaatattttatgccaagaaaagcatactataaagcaaatatctattattctcctaaacgaatgcctagcatagagaaaatacttaatacacatttgttgacttaaatttaattcaaggattgaaaaattaactggatatcttgaaatatacagtaatgattgtccttagactcttgaactttaccatctttcctattcatatatctatatagtaaatttcactagaaaaattcttttaaaattgacagaagataatttataccttttatggactctgaagacacttcaaaacattaaaagtccttatgtctttggtaatgaaacaataacactcaatgaaggatgtattaaaatttttgacttaattttgaaatcgtatatatgagctatactttaacattatgagagaaaagcataaaacaaaaataggtagttcttggcttttaacattaatgcaaatcatgcagaatttgagttataaatttaaatataaattgaccattgatgatatccagtttttcattttttacctgtattgcattttccccctagagaaatagatcaaaagagcacaagagtatgcgtacatagtttaccaggtagtagaagtgtgttaaaatgttcctgtaaaagaaacattggtaaatttaaatacatactgttctaattttgtattttttaatttttgaatttgacattgagtttaattcagcaacaacaaaaaatacatataaaactagaaagggactttttttcctttcttttcataatgaagcagatcaacttaaaggataataaaatttttaaagaaaagatattctaatgtactctcaataattctacagaaataaaactgtaaagtgcaatgtgaaatcaaagattatagtcattgtataatttggcttggaggctatgaaatgtctttttttctttttggtattttacattattcacattttagaataacaagaacaccaagaattacccctaaaacagagaccctgtatttaatctactttgatcagagaagtagaatttataacaggttagctaaaattgggagcatgccttaaaacttaaagattgtatgcatatatgtgtatatgttataaacgtgaaatatatttgacacacacattcacatataaattgttaaaaactgaaggcagaatggaactaatatatgtaacagagaaaaacaataaattttatgaacttgttttatatttgcatatcaagagtcaagtatgatgtttctttaagttgactttttttacttcattatttttaggaataaatgtaagattttacaaatcttttatttccccacaagatctgaagtttggtatttttgcattatgacagttgttgagactaggattttaagctaggatatgattatatttcctatataactaaaaattttgtttcataaattttaaaataattatttttgactatgaacattagtccaaatttaatatttgacacagttcataccagcttgctacaataatgataatttattagtctttctgttatttaaagaataaaaacatgcttataaaagacttttaatgaaatgttgcctttttaaaataattatacttgcacatgaaaataaaatataaagtcaataatagtccttgtagcccaatgggaattgattctgtttattgtctgtaccattttgctaccagttacattgaactgctttaaaataaataataaaattatttctaatgatgaaaa

SEQ ID NO: 168135 - DNA, 3146 bp, Homo sapiens
  Payload ID: 13071
  Gene Symbol: KCNT2
  Gene Name: potassium channel, sodium activated subfamily T, member 2
  ENST ID: ENST00000451324
  CDS Start-End: 671-1783
ccctcctctcctccatttgttgtttgatgtttcccactctttgaggaaggatggttgatttggagagcgaagtgccccctctgcctcccaggtacaggtttcgagatttgctgctaggggaccaaggatggcaaaacgacgacagggtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctggatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcaagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataacccatgacttactcaggtgtggagtgacttttgctgctaatatggtggttgtggataaagagagcaccatgagtgccgaggaagactacatggcagatgccaaaaccattgtgaacgtgcagacactcttcagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcgaaaaatagcatcacaagattttattggatctacttcctgacgttacttaaattgtctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatggacacaga

SEQ ID NO: 168136 - DNA, 3622 bp, Homo sapiens
  Payload ID: 13071
  Gene Symbol: KCNT2
  Gene Name: potassium channel, sodium activated subfamily T, member 2
  Uniprot ID: Q6UVM3
  ENST ID: ENST00000609185
  CDS Start-End: 51-3257
ccctcctctcctccatttgttgtttgatgtttcccactctttgaggaaggatggttgatttggagagcgaagtgccccctctgcctcccaggtacaggtttcgagatttgctgctaggggaccaaggatggcaaaacgacgacagggtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctgcatttgtgggatccaacatctggaacgaataggaaagaagctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataaccccctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcgaaaaatagcatcacaatctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatggacacaga

SEQ ID NO: 168137 - DNA, 695 bp, Homo sapiens
  Payload ID: 13071
  Gene Symbol: KCNT2
  Gene Name: potassium channel, sodium activated subfamily T, member 2
  ENST ID: ENST00000466914
  CDS Start-End: 1-508
tagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgttctgaaggctggaaatccaagatctaggtgccaacatgatccagtgctgagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaat

SEQ ID NO: 168138 - DNA, 3695 bp, Homo sapiens
  Payload ID: 13072
  Gene Symbol: KCNU1
  Gene Name: potassium channel, subfamily U, member 1
  Uniprot ID: A8MYU2
  ENST ID: ENST00000399881
  CDS Start-End: 38-3487
aaatgacctggcaattccgtctactgatgtctcgaacatgtttcagactaagctacgaaatgaaacttgggaagacttgccaaaaatgtcctgcacaactgagatccaagcagcattcattctctcttcctttgtgaccttcttcagtggactcatcatcctgttgatcttcaggctgatctggagatctgttaaaaaatggcaaatcatcaagggaacaggaattatcttggaactgttcacatcaggtaccatcgctaggagccatgtaagaagcctccacttccagggacaatttcgtgatcatatagaaatgttgctttcagcccagacctttgtggggcaagtgttggtgatccttgtctttgtactaagcattgggtctcttataatctatttcatcaattctgctgaccctgttggaagctgttcatcatatgaagacaaaaccattcctattgatttggttttcaatgctttctttagtttctattttggattgaggtttatggcagctgatgacaagatcaagttctggctggagatgaattcaatcgtagacatctttaccatcccaccaacctttatttcttattatttgaagagcaattggctaggtttaaggttcctaagagccttgcgcctgctagaactccctcaaatcttgcaaattctacgagccatcaagaccagtaactcagtgaagttttccaaactgctgtcaataattctcagtacctggttcacagctgcgggattcattcacctggtggaaaattctggtgatccctggctcaaaggtagaaattcacagaatatatcatattttgagtcaatttacctggtcatggcaacaacgtcaaccgttggatttggagatgtggtagccaagacatccttaggacggaccttcatcatgttcttcacactggggagtttgatattatttgcgaactatatacctgaaatggtggaactgtttgctaacaagaggaaatacaccagttcctatgaagcactcaaaggaaagaagtttattgtggtctgtggaaacatcactgtggacagtgtgaccgctttcctgaggaatttcctccgcgacaagtcaggagagatcaacactgaaattgttttcctgggagaaacccctccttctttggaacttgaaaccatatttaaatgctacttggcctacacaacgttcatttctggatctgcaatgaagtgggaggatctgaggcgagttgcggtggaatctgcagaggcatgcctgattatagccaatcctttgtgcagtgattcccatgctgaagatatttccaacattatgagggtgctctctatcaagaactatgattctaccaccagaatcatcatacagatactgcaatcccataacaaggtttatctgccaaagattcccagctggaactgggacaccggagacaacatcatctgctttgctgaattaaaacttggatttatcgcccaaggctgtttggtgccaggcttgtgtaccttcctaacatctctatttgtggagcaaaacaaaaaggttatgcctaaacagacctggaagaaacacttcttgaatagcatgaaaaacaaaattctgacccaacgtctctctgatgactttgctggaatgagctttcctgaagttgcccggctctgctttctgaagatgcacctcctgttgatagccatcgaatacaagtccctctttacggatggtttctgtggtctgatactaaatccacctccacaagtgaggatacgtaagaacacattagggttctttattgctgaaactccaaaggacgtcagaagagccttgttttactgttcagtctgtcatgatgatgtgttcattcctgagctaattacaaactgtggctgcaaaagcagaagccggcagcacatcacagtgccatcggtaaagagaatgaaaaaatgtctgaagggaatctcctctcgtatatcagggcaggattctccgccaagggtatctgcaagcacttcgagcatatcaaacttcaccaccaggactcttcaacatgatgtagaacaagattctgaccagcttgatagcagtgggatgtttcactggtgcaaaccaacctctttggacaaggtgactctgaaacgaactggcaagtcaaagtataagtttcggaaccatattgtagcatgtgtatttggagatgcccactcagccccgatggggcttcggaactttgtaatgcccttgagagccagcaactataccaggaaggagctgaaggacatagtgttcattgggtctctggactatctacagagagaatggcgatttctctggaattttccccagatatacattctgcctggatgtgcactttattctggagacctccatgcggccaacatagagcaatgctccatgtgtgctgtcttgtcccccccaccccagccatcaagcaaccagactttggtagacacagaagccatcatggcaaccctcaccatcggatccttgcaaattgactcctcctctgacccgtcaccctcagtgtcagaggagactccaggttacacaaatggacataatgagaaatcaaactgccgaaaagtccctatccttactgaactgaaaaatccttccaacattcactttattgaacagcttggtggactggaagggtccctccaagaaacaaatctgcatctcagcactgccttttctacgggcactgttttttccggcagcttcttggattctctgctggccacggccttctacaattatcatgtcctggaattgcttcagatgctggtgacaggaggagtaagttctcagctggaacaacatttagataaggataaagtctatggtgtggcagatagctgcacgtcgctcttgtctggaagaaaccggtgtaagctggggcttctgtccttacacgaaaccattttatcagacgttaatccaagaaacacctttggacaactgttctgtggctcattagatctttttggaatcctgtgtgttggcttataccgaataattgatgaagaggagctcaacccagaaaacaaaaggtttgtgatcacccggccagccaatgagttcaagctgctgccttcagatcttgtgttttgtgccatacccttcagcactgcttgttataaaaggaatgaagagttctcattgcaaaagtcatatgaaattgtaaataaagcatcacagacaacagagacacattcagacacaaattgtcctcccaccattgattcagttactgagacattgtattcaccagtctattcttaccagccgagaactaactccctctcttttcctaagcaaatagcatggaatcagagtagaacaaacagtattatatcatctcagatacctttaggtgacaatgcaaaagaaaatgaaaggaaaacttcagatgaggtttatgatgaggatccctttgcatattcagagccactatagacctgcccatattcttcacgtgctcttaacttgctgcttacaaatcatctcctgagatgctaactttgaacaaagaaaataagaatggaagcatgccatttttctgcccattgcttagtggttcatgaaggccacactgttttgggtgagacaaaagtctaatgccactggatcttgtgtgataaataaagaaatatatgatcaatgc

SEQ ID NO: 168139 - DNA, 334 bp, Homo sapiens
  Payload ID: 13072
  Gene Symbol: KCNU1
  Gene Name: potassium channel, subfamily U, member 1
  ENST ID: ENST00000518904
  CDS Start-End: 70-225
ggagatctgggatcccagaaatctacactcattaatatcacttcagatgatccagatacatgagaagcaatgataaagaaaacagaatttagcaatgtgtgcagtatattttacttaatcctgcaagcaatgctaaaaggccttctacaattatcatgtcctggaattgcttcagatgctggtgacaggaggagtaagttctcagctggaacaacatttagataaggataaagtctatggtgtggcagatagctgcacgtcgctcttgtctggaagaaaccggtgtaagctggggcttctgtccttacacgaaaccattttatcagacgttaat

SEQ ID NO: 168140 - DNA, 3745 bp, Homo sapiens
  Payload ID: 13072
  Gene Symbol: KCNU1
  Gene Name: potassium channel, subfamily U, member 1
  ENST ID: ENST00000522372
  CDS Start-End: 29-2872
ggcaattccgtctactgatgtctcgaacatgtttcagactaagctacgaaatgaaacttgggaagacttgccaaaaatgtcctgcacaactgagatccaagcagcattcattctctcttcctttgtgaccttcttcagtggactcatcatcctgttgatcttcaggctgatctggagatctgttaaaaaatggcaaatcatcaagggaacaggaattatcttggaactgttcacatcaggtaccatcgctaggagccatgtaagaagcctccacttccagggacaatttcgtgatcatatagaaatgttgctttcagcccagacctttgtggggcaagtgttggtgatccttgtctttgtactaagcattgggtctcttataatctatttcatcaattctgctgaccctgttggaagctgttcatcatatgaagacaaaaccattcctattgatttggttttcaatgctttctttagtttctattttggattgaggtttatggcagctgatgacaagatcaagttctggctggagatgaattcaatcgtagacatctttaccatcccaccaacctttatttcttattatttgaagagcaattggctaggtttaaggttcctaagagccttgcgcctgctagaactccctcaaatcttgcaaattctacgagccatcaagaccagtaactcagtgaagttttccaaactgctgtcaataattctcagtacctggttcacagctgcgggattcattcacctggtggaaaattctggtgatccctggctcaaaggtagaaattcacagaatatatcatattttgagtcaatttacctggtcatggcaacaacgtcaaccgttggatttggagatgtggtagccaagacatccttaggacggaccttcatcatgttcttcacactggggagtttgatattatttgcgaactatatacctgaaatggtggaactgtttgctaacaagaggaaatacaccagttcctatgaagcactcaaaggaaagaagtttattgtggtctgtggaaacatcactgtggacagtgtgaccgctttcctgaggaatttcctccgcgacaagtcaggagagatcaacactgaaattgttttcctgggagaaacccctccttctttggaacttgaaaccatatttaaatgctacttggcctacacaacgttcatttctggatctgcaatgaagtgggaggatctgaggcgagttgcggtggaatctgcagaggcatgcctgattatagccaatcctttgtgcagtgattcccatgctgaagatatttccaacattatgagggtgctctctatcaagaactatgattctaccaccagaatcatcatacagatactgcaatcccataacaaggtttatctgccaaagattcccagctggaactgggacaccggagacaacatcatctgctttgctgaattaaaacttggatttatcgcccaaggctgtttggtgccaggcttgtgtaccttcctaacatctctatttgtggagcaaaacaaaaaggttatgcctaaacagacctggaagaaacacttcttgaatagcatgaaaaacaaaattctgacccaacgtctctctgatgactttgctggaatgagctttcctgaagttgcccggctctgctttctgaagatgcacctcctgttgatagccatcgaatacaagtccctctttacggatggtttctgtggtctgatactaaatccacctccacaagtgaggatacgtaagaacacattagggttctttattgctgaaactccaaaggacgtcagaagagccttgttttactgttcagtctgtcatgatgatgtgttcattcctgagctaattacaaactgtggctgcaaaagcagaagccggcagcacatcacagtgccatcggtaaagagaatgaaaaaatgtctgaagggaatctcctctcgtatatcagggcaggattctccgccaagggtatctgcaagcacttcgagcatatcaaacttcaccaccaggactcttcaacatgatgtagaacaagattctgaccagcttgatagcagtgggatgtttcactggtgcaaaccaacctctttggacaaggtgactctgaaacgaactggcaagtcaaagtataagtttcggaaccatattgtagcatgtgtatttggagatgcccactcagccccgatggggcttcggaactttgtaatgcccttgagagccagcaactataccaggaaggagctgaaggacatagtgttcattgggtctctggactatctacagagagaatggcgatttctctggaattttccccagatatacattctgcctggatgtgcactttattctggagacctccatgcggccaacatagagcaatgctccatgtgtgctgtcttgtcccccccaccccagccatcaagcaaccagactttggtagacacagaagccatcatggcaaccctcaccatcggatccttgcaaattgactcctcctctgacccgtcaccctcagtgtcagaggagactccaggttacacaaatggacataatgagaaatcaaactgccgaaaagtccctatccttactgaactgaaaaatccttccaacattcactttattgaacagcttggtggactggaagggtccctccaagaaacaaatctgcatctcagcactgccttttctacgggcactgttttttccggcagcttcttggattctctgctggccacgctcatgtggaaattggccataaagggatcccagtttcaaggaagaagctctggcctttgctggccttctacaattatcatgtcctggaattgcttcagatgctggtgacaggaggagtaagttctcagctggaacaacatttagataaggataaagtctatggtgtggcagatagctgcacgtcgctcttgtctggaagaaaccggtgtaagctggggcttctgtccttacacgaaaccattttatcagacgttaatccaagaaacacctttggacaactgttctgtggctcattagatctttttggaatcctgtgtgttggcttataccgaataattgatgaagaggagctcaacccagaaaacaaaaggtttgtgatcacccggccagccaatgagttcaagctgctgccttcagatcttgtgttttgtgccatacccttcagcactgcttgttataaaaggaatgaagagttctcattgcaaaagtcatatgaaattgtaaataaagcatcacagacaacagagacacattcagacacaaattgtcctcccaccattgattcagttactgagacattgtattcaccagtctattcttaccagccgagaactaactccctctcttttcctaagcaaatagcatggaatcagagtagaacaaacagtattatatcatctcagatacctttaggtgacaatgcaaaagaaaatgaaaggaaaacttcagatgaggtttatgatgaggatccctttgcatattcagagccactatagacctgcccatattcttcacgtgctcttaacttgctgcttacaaatcatctcctgagatgctaactttgaacaaagaaaataagaatggaagcatgccatttttctgcccattgcttagtggttcatgaaggccacactgttttgggtgagacaaaagtctaatgccactggatcttgtgtgataaataaagaaatatatgatcaa

SEQ ID NO: 168141 - DNA, 560 bp, Homo sapiens
  Payload ID: 13072
  Gene Symbol: KCNU1
  Gene Name: potassium channel, subfamily U, member 1
  ENST ID: ENST00000522417
  CDS Start-End: 13-354
gatgtctcgaacatgtttcagactaagctacgaaatgaaacttgggaagacttgccaaaaatgtcctgcacaactgagatccaagcagcattcattctctcttcctttgtgaccttcttcagtggactcatcatcctgttgatcttcaggctgatctggagatctgttaaaaaatggcaaatcatcaagggaacaggaattatcttggaactgttcacatcaggtaccatcgctaggagccatgtaagaagcctccacttccagggacaatttcgtgatcatatagaaatgttgctttcagcccagacctttgtggggcaagtgttgccctgttggaagctgttcatcatatgaagacaaaaccattcctattgatttggttttcaatgctttctttagtttctattttggattgaggtttatggcagctgatgacaagatcaagttctggctggagatgaattcaatcgtagacatctttaccatcccaccaacctttatttcttattatttgaagagcaattggctaggtttaaggttcctaagagccttgcgcctgc

SEQ ID NO: 168142 - DNA, 1013 bp, Homo sapiens
  Payload ID: 13072
  Gene Symbol: KCNU1
  Gene Name: potassium channel, subfamily U, member 1
  ENST ID: ENST00000523973
  CDS Start-End: 88-1013
acagtgaactctgattcctggaattgttaccaggcgaccacggcgtcatcaaatgacctggcaattccgtctactgatgtctcgaacatgtttcagactaagctacgaaatgaaacttgggaagacttgccaaaaatgtcctgcacaactgagatccaagcagcattcattctctcttcctttgtgaccttcttcagtggactcatcatcctgttgatcttcaggctgatctggagatctgttaaaaaatggcaaatcatcaagggaacaggaattatcttggaactgttcacatcaggtaccatcgctaggagccatgtaagaagcctccacttccagggacaatttcgtgatcatatagaaatgttgctttcagcccagacctttgtggggcaagtgttggtgatccttgtctttgtactaagcattgggtctcttataatctatttcatcaattctgctgaccctgttggaagctgttcatcatatgaagacaaaaccattcctattgatttggttttcaatgctttctttagtttctattttggattgaggtttatggcagctgatgacaagatcaagttctggctggagatgaattcaatcgtagacatctttaccatcccaccaacctttatttcttattatttgaagagcaattggctaggtttaaggttcctaagagccttgcgcctgctagaactccctcaaatcttgcaaattctacgagccatcaagaccagtaactcagtgaagttttccaaactgctgtcaataattctcagtacctggttcacagctgcgggattcattcacctggtggaaaattctggtgatccctggctcaaaggtagaaattcacagaatatatcatattttgagtcaatttacctggtcatggcaacaacgtcaaccgttggatttggagatgtggtagccaagacatccttaggacggaccttcatcatgttcttcacactggggagtttggtgaagaatatttttaatatatt

SEQ ID NO: 168143 - DNA, 2161 bp, Homo sapiens
  Payload ID: 13073
  Gene Symbol: KCNK1
  Gene Name: potassium channel, two pore domain subfamily K, member 1
  Uniprot ID: O00180
  ENST ID: ENST00000366621
  CDS Start-End: 169-1179
gcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccatagtattctgctgcaataaatgtttctaccctcttgcgatagaatggtgtcagatgtctaacatgtttataaacatttttttgaattgaacaggttatgaaaaggatttattaaaaggttaagatactttgttttgaaagtacattgtgatttgcagccacctagcactaaagcatagaacttaaacacgaatccctaaatgaacagattatgttacattaatctgagaattttaaatttagaagctaaaataaataaaaatcacagctggttgt

SEQ ID NO: 168144 - DNA, 726 bp, Homo sapiens
  Payload ID: 13073
  Gene Symbol: KCNK1
  Gene Name: potassium channel, two pore domain subfamily K, member 1
  ENST ID: ENST00000446915
  CDS Start-End: 1-726
gtcctgagggttttatctcctgatttggttagaagattgttgaatctggctgtgagagcctttcaagtgcctaaaggagagagcttgaacttccctgagagtacaccaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacc

SEQ ID NO: 168145 - DNA, 2396 bp, Homo sapiens
  Payload ID: 13074
  Gene Symbol: KCNK10
  Gene Name: potassium channel, two pore domain subfamily K, member 10
  Uniprot ID: P57789
  ENST ID: ENST00000312350
  CDS Start-End: 123-1754
gcaaggcatggagcctgcactttactctgaatgttggtggcgccttcagagcattgttagcaagggtccatgtgatcacactgacacctgagagagtgacacaccatgtacatggctggtatatggaggatggatttaagggggacaggactgaaggctgtcgcagtgattcagtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataa

SEQ ID NO: 168146 - DNA, 2725 bp, Homo sapiens
  Payload ID: 13074
  Gene Symbol: KCNK10
  Gene Name: potassium channel, two pore domain subfamily K, member 10
  Uniprot ID: P57789
  ENST ID: ENST00000319231
  CDS Start-End: 452-2083
gtgtgcgggtgtgtgtgtgcgggagtgtgtgcgcacacgccttcgggggctggagtgacactgcagtgggcttctccgtagccccagccttcaggctgcgcagcccctaacctgccggcaccgcttttgggaagcagcttggctcttccatctccccaagccttcctctccatcctttcatccacccctcgccgatcttactttttcttttacccacggggccgcggccggccaccccctggccggtgcaaacacccaagccctctccagttctcccccaagctaatattttcccacctgtctttttctggggttcctccacgagccagtccaaggctcccccatcctcggaaattgttttgttggactgctaaaccgaggcgtgtaaagcttgaggactttattattatttgggttcttttcatttcttccccttctgggcaacgaagcaatgaaatttccaatcgagacgccaagaaaacaggtgaactgggatcctaaagtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataa

SEQ ID NO: 168147 - DNA, 7501 bp, Homo sapiens
  Payload ID: 13074
  Gene Symbol: KCNK10
  Gene Name: potassium channel, two pore domain subfamily K, member 10
  Uniprot ID: P57789
  ENST ID: ENST00000340700
  CDS Start-End: 453-2069
gcaggcatcgtctcctccggtctcacagctaccccgggctggagcgtggggagggggtaagggagccagccaactcggggaaacttcgttgccagagatgactggggttttcgggctttcccagccttcccatgccgggccacacggcattcattaaagtggtggggcaactattggtgcgctccagccgggcaggttttgagctgcagagacccgtgcccggtagcagcgctttgccaccgagtgcacccaggacgcagtggccgccagcccgggtctcctgctgggggccggcgagtgcagggagactttgcgccacgatgttttgttttcctgccgcaggaacgctaggcagtctctttccaccagacttaacccgcctgaagcaatagccatggaagttgcggcggcacagagggagacagaaccgcttggagcggcatctttcttggatgttttttctctacacagacttctttctttccttggtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataatcacaaacacatcacactgtggatatcaccttaaccaatgacagaagcctgctgagtttggtctttctcacaggggtaggtagtccacatgaactggcgagcagtggtgaaaacatgacatcaactgctgcgtggttaaaggccaatcatgcattttcctcagtgggtgcaatggtgacaataaactgatttggaaatgtccatgtactttggttataacttgttttgataagaggggtagaaataccaaaacaattgccttgcatgatgccagtggcttgctgttctgtctagctgatcctacatttttacaaaagtagacatcctgcatttctgagacacactgaggaggaccatggcatctttccatctcagggctttttgtcccttgggtgtcttagggtagacatagtgataagatccaatctcgctatctccaaacaaaaagaaaatgtaccccttgtacagtaagcttgaaatgtttttattgcttgcagcgtaagtgccattaattccatttaacaatgatacttagaaatatttaaaatatttcattttacttttatgtttgggcattcctttattctgaaaaagtcaccactgctccttgcttgtttctacatctcacatcggttactcactaaaactggaacaccctagactgattgttcccaggcaaacgataagctaacacatcataattatgattggtctgtgaggctagaacatcccgcagaggaaagtcggggaatggctagtcataggttgcatgatgattttaaatgggtttgtatcagaaaggggaaaatacatactcctgtgtatgcctcagtctttatcataattggctggttcacagctagctctttgggccacacgtgaaagcatttggacctggcaacaccaggcagttgctggttatgggtgttctaggctcactgctaccttttacagagttcacgggattttacgtaactaacccgcagtgtggatttaccaaaagatcacagcactagcggagacttccagaaactgtctcatgctttctgacctccagggaaagttgtacccacgacatcctcaaccactggtaccatggaagacctgtccctgcccatttctcaaaaatgcacagctcttccctgcctggagcacatgaagtcccatctccctgtccccagacctttaggctctgttgaagttctggcattgcttatgagacccttcctgtccaaggaaggtctaagtcaactcctccattggactggagatgaggctcactggtgacatcctgtgtcgactcagtaataaatagtcacttgggaggcgatgtttatgcaggtgtggatgttgagttttactatgggaatcattccagcctgacaaaatgtgttttaaggaataggtagataactgggacttcctctgttattctaacaagtcgaagcttcctaattaaactgtccatggatctcacttatttggtttccactctgtgttatctggtacgttctttgtagcagtgtgttaaaattccaggccctacggccaaatctggcagaggcttccctctcatttatccagtgccttctgtgggccaggcacaggattaggcactttatgaacgtcagctcattgaaacttcacgacactatgtgggaagtatttgcaaacccattatatacacaaggacacagaggctcagggaagctatgttatttatccaatggcacacagcaagaaagtggtagagctggtattcaaagtctgaccaaagtctgctttcaacttcactacagtgtctgtgtcatgcatccttgtgattgtgtgtgtttgtgtgtatgtgtgtctttctagcttcatggacacagcttacagatgtggggagcagatatggtggaatctccaccaccaagagggcacaaggtctttgtgtaaacatggctcaaagggttgcccctgcagacacctactgtacatttatttggttttggaaattttgtatgtggcaccctttaaaaaatgccctttgaaagcactcttttgcactttacttgctaactttgtagaaactctgcatacagcaggaataaaatagttcaaagcactaagctgcatactctaccaaatggaacaggtgcatgtgttggtatgtgcatagatgcttccccaaatgagtcaaatcagtcacacagagggatcaaacataaccttgggctgggggtgggaaaattttctacataacccattccctgagacatttggccaagaatgtgatgaacaaaatcaaagaagatcctctatggtgattgatcgattaaatatgtgtgcaaagtgtttagaaacctatgaaatactctcgcaaagatgctgagagagaataagaggttggattcctcttcatataaactaattttggaggaggccagttggtttgaagttacttgaatgttaccttttttagatggggccaaatggcatgtagaatacacgtgataggtcaaagctgctacacattctatacatgcatcagcacagccccccctttccaatctgcactcccattccagcataaacctaggagaaatgtttcgatttcacacaaagaaagagcacacgtccaccatcttcagtgggggctgtcttttgcttcactggcaagcaggcactgaatttttcttgcatgacaaatctggaggtttactggtgagagagccaatgggcattttttcctggaaagagtacagctccatacccagtcctaacccaacagtgatatttatcactttggggcagggctgtatagagtgtgtgtgtgtgtgtgtgtgtgtgtgtgtgtgtgtgtgtgtgtgtgtgcgggttggggtggtgttgggccatctctggcctgttactaaggtaactaggactatttgtgttccagcagtcatagcctgtgattgtgggtgcatcagttctctgcctagatctcttgttaccttgtctgcacatcaagggagggagttgagcacagatacttgtcaagggccattgtagttgtgcagttctctaatgaaacactccctagtccatgagttcacaaaatttattaagattaaattataagttggatttgtgaataatgactaattaattgtcttgcccattttaggttaaggtgagagcttagtctcttgccctttgggatttgtcttttgggggattaatggagaccagatgtacttgggagactggtgtccaaattcggatcatgccctgtgtaggctctctctatcctcccttatagctctttagtgtactgtcaccgggagggctcatgctgtgagggcattttttgcatggtgttaagactagttaaagaaattttaagctgttgttatttgcagtcaattgtagtacttcatgtatcatgaattcaagtactatgatcagacagacatctctctctctctcacacacacacacacacacacacacgcacacatacacacacacacacacacctgaggaaatggctgctttgggttctataaggaccattccatgtttaaagtcctagttgagctgaatgctaagaacctgcccccttgcctccctctgagatgatatcatttcctggcttcgtcaatgctgcctgtctatttgcatgctgggttctgaggactagtgagaaggtgaccagagtttgggtggggctggtttttacccactggatttggtgagaatatgaagcatccagtgtgtaccagggtttctgaaccacgggaaaggcgtaggaaaacaaacattcagagcccctgtaaaacgagaaaggaaaaaccagccagtgttgcattccacatctctgcttgttgcattttgctaatatggggttattctttctcactgttaggatgcaattgtgtgcaaagacagtggctgagtgaacagtaagagctggctagtaatggccttaaaaagaaaaagggtaactctctgaaacaaagatcactttagtgtggcattgtggatgctgttaattctgcatagggaaactttggaacagcatgctaattacatggctgtaagcaaagccctgtcctctgtctctgcaccataccttcattggacttcaccaacccatccatactccatgtaaacctcagttctctcatgcctgccctaagtcagttgacatcagtgcagtggcattgaggagaaatgagaggtgtctctgattttactgaaagttattatcattttcacaggtgcctgagatttggtatctactttgtgttcttgattcttaggtgaaaaatctgaaatagttccctgtgcattaaaataaattattttgagaggactcctgctccgtcgattcagcagacctatgctgcagaaggtaactgcggaagctctcttttgctgtcagggctctgagcttgaagggagaaggtgcagtggtgcctagaagtgatatgcaaaccacctcacatgccagcctctggcctccttcccatcccagagtcacagacaggggacccagtgacaatgatgataaatccatgtgtggaggtgttttacttatttttctttccgtaggatttcatggtgctttaaaaaaaaaggcattttacagaaaataatgtggggggagggagatttcataatgttcttagggaaagtacaaaacaaatttgcttgtgacatttcaataagctgtgctgctattgtctttatttgatgatgtaatttttttttcaatgatggagaaaaattgcaacaaagaccttctggaagatccaatccaa

SEQ ID NO: 168148 - DNA, 548 bp, Homo sapiens
  Payload ID: 13074
  Gene Symbol: KCNK10
  Gene Name: potassium channel, two pore domain subfamily K, member 10
  ENST ID: ENST00000556282
  CDS Start-End: 79-548
aaccaagcgtgtctccggctgcaactccagcaagcgcgccgctgccgcctccacgcccgcccgccggccggccgagccatggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagg

SEQ ID NO: 168149 - DNA, 6227 bp, Homo sapiens
  Payload ID: 13075
  Gene Symbol: KCNK12
  Gene Name: potassium channel, two pore domain subfamily K, member 12
  Uniprot ID: Q9HB15
  ENST ID: ENST00000327876
  CDS Start-End: 609-1901
gaaaggagcgcttccccggactcggctcggctccgaggctctgaagccgacgccgccagctcagccccgggggcgggagcaggactgcccgcacagcccgcacctaggaggcgccgatcccgaacgcctcatgggacgcccccgggggctctctccacgccttgctgccgcgtcccggtcctaggcgcccgggatccacggcccaccccgcccgcagcccgcggcctgtctggagaggagtatgaggcccggggccccgcggacgccggccaccgggcggcaggggcctagctgcggagccccgcgcccgagagcggcgggtaaggagccgcgggagccggcgaggcgtcggggcgcgcagaggagcgcccctgcccgggcacccgctgggccacgggactcgcgtgtggcctgagcgccggggaggaggcggaggcgcccctctgtccgggctctgggaaggcgacgaggggctctgcgaaggcggcgaggggctccgcggcggccccggacccctggccaccatcctcacgctcctgctcccgccggggggatgtcgtggcccgggccccgagcgccgccccggccccggggctgagctccggaccatgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcggcgctcgagagccccggcgaggcggaggcgcgggcgcgctggggcgccacgctgcgcaacttcagcgctgcgcacggcgtggccgagccagagctgcgcgccttcctccggcactacgaggccgcgctggccgccggcgtccgcgccgacgcgctgcgcccgcgctgggacttccccggcgccttctacttcgtgggcaccgtggtgtcaaccataggtttcggcatgaccacccccgcgacggtgggcgggaaggccttcctcatcgcctacgggctgttcggctgcgctgggaccatcctgttcttcaacctcttcctggagcgcatcatctcgctgctggccttcatcatgcgcgcctgccgggagcgccagctgcgccgcagcggcctgctgcccgccaccttccgccgcggctccgcgctctcggaggccgacagcctggcgggctggaagccctcggtgtaccacgtgctgctcatcctgggcctgttcgccgtgctgctgtcctgctgcgcctcggccatgtacaccagcgtggagggctgggactacgtggactcgctctacttctgcttcgtcaccttcagcaccatcggcttcggggacctggtgagcagccagcacgccgcctaccggaaccaggggctctaccgcctgggcaacttcctcttcatcctgctcggcgtgtgctgcatttactcgctcttcaacgtcatctccatcctcatcaagcaggtgctcaactggatgctgcgcaagctgagctgccgctgctgcgcgcgctgctgcccggctcctggcgcgcccctggcccggcgcaatgccatcaccccaggctcccggctgcgccgccgcctggccgcgctcggtgccgaccccgcggcccgcgacagcgacgccgagggccgccgcctctcgggcgagctcatctccatgcgcgacctcacggcctccaacaaggtgtcgctggcgctgctgcagaagcagctgtcggagacggccaacggctacccgcgcagcgtgtgcgtcaacacgcgccagaacggcttctcgggcggcgtgggcgcgctgggcatcatgaacaaccggctggccgagaccagcgcctccaggtagaccgcccgtccgcccgcgccggggaccctctccaggccgcggggccgccgggcgtggtttgcttctctcagtcactgctggcgctttcttaatctttatccaataaaatgaaacaaaaaaaatttttttaaagaaatactatttggccaggcctgatgttatcaagggcaggttttggggacgcctgtgttccttgtgagtcccctcttggagaaccgtggcccccagcagattctccttcagggagagaaaacgtggccccccaggcccacacccagggcataccgcagcgaggagggttttgcagactggcactaaaccccgtccccatgcacagaagcagccggcaaccccaaagcatatggtgcaacttttcgtggctctgaattacctcctcagcatttagaatcctggcccagcctagcagcttccttctggtcgtcagaagtgatatagtcacagttttgacaggtgggggttgggacagccatatgttgcctcccgatgtatatatatagaacagccactacacacagagaatggtgtagtattatgcaatgagatgaaacatagcaccaacttgcggactgtggcatttcccccagatttggaaattgcagtggtgaggggcttagctggcctttctcagctcagagttagtccatttagcacagagcacagggcagctacttctaatggtgggcggtccagggcacctgtgaggaggggagcggtgaggctgcaggagccctgctgggcttttagctggctgatctccaggctcggatcggcagatcttgaatcccccaaccgtcctttctttcacaagctcatccacagcagtgcttttcaatattaaccaggaatatctgagtcttctcagacaagatatttatttgttggtgtggattttttttttcttaactactgttgatcagttcaacttttccccctttaagagatcatggggttgccgggcgcagccctccagcttctcctcctcctcctctgaaggaggcacctctgccagctgcgtccttgggaaccagggcctgcagcaccaggaacccaaaagaagccatcttgcaaatgtcagggtatttggctccagaggccatgatgtgtttggggtcaggaaagatagaatccctttctaaatattgtttatcaagaggatttgtcttctccatgcacagcctattggaggcagaggaaggcaggagggaggtagctggtgaaactggtggatggaagtaatgttaggattacagttttgctctcgggctgagggacagattctcccagacttgccttctgcagcatagggggtccctgacctggaggaaggccagatacccaggcttcattgaaaggatagtggtctgggggtgtaaacgaacactctctctgcccatttttctcatatatgatgagggcaaggacaggtgccagagtttatacaggcacggcgtgacccaccagtatgcacagcttctgataggaagtcttagaaaagcaccgcctcaccgcctccagctggagccatgctgtgaaatctctctccctggcaaatgtgcgtggaacacacacacacacaaacatgcacgcatgcgctcacgcacccagcattagagtcaaacttgaatgtcaaactcttctttccccttctagttcatggcaggaagggaaagcttacctgagatctcagtgactctccagctattttgggtaatttctgatttgagttgggattggtttttaaacacaggccctaatctggggtgaagccagtgaagcagcgctggccaggagagacgtcagtcttgctaaatcctgaaggtgggttcctgtgaaaaccatgctttcaggattcactgtgactgtcaggccagcccagtgagtgccccccatccaacccatggttgcggtcacagtgaagggattgcccacgcaggggcgcacgtgttctctagggcagggccctctgacaggacctggaaataaaatccacatttatccctttaaaaaagggaacgattaaaaggcatccaattagaggtgttacctaggcaacaggaaataacttggggatcagagccatccagagagggaagaagagatccccatgatagaggcatctagacagtgaggacttgatctgcgggcaaaataacagcctacccacaggaagtgagccccagcaacagtacagcagcctaaaacccaggcatcaagactgtgtgagctagacaggtctaaagaaacctccaggcaatcccccgcccagcgtgcaggactacacagaatcgtggtctccatgggaggaaccaggacccacctccagagaagaaaaactcaaaatgtttcttggcagtcttctctgttggcggtgcttcctagactctatcctaagttgcttatgctgcagcctcagctgtttttacttgttttcctatgctttggttttggaaagaggcaattggaggcagcttgagcaatcttctaaaggaatggtaagcatggtttcaaggggcaggaaaatgagacccttcctcttcccacctcccaacttcccagagaaacgccagtcctccaaggtacaatggcagctcaggatccagtggcacatgtgtatttttgcctatgttcccctgtccccatcccccaatccagtctcagtcacactgccatgatacatcacaccatcatccttcatctcaggccaaagggctcagcgccccagacgacagggactgcttccctgaagcagggatgtggttctcccatcatttcaggaacagtgacattgatagggatgcctttctttggtgcaggttcttctgaacctcaggccaagaaagagctccattccctcagatgctgtggcctctctcactgtcttgggggtctccagtttgcacaccactggtagctcactgtagcctacaatttcctcatgctccaggatttgcttcctaaccttaggcctggacttacccatcatgccggtgctgtggggctcccttaaagtttgaatgaactccaagaggccctcaccatatgactgtggccacagagaatccagagtcttggctagcagccttctcagagctgaggagaaaggtaaagaagccaccctgggtgtcctagcttgctaaagccaggtggtcaggcctttgtgtcctctgaatgaagcagtgcctccaggcctggagaaggcatcagaaggcttaggcaatctcaggctctcattttgtggaaaatgccagacagccctgggcatttgcacagcatcatgcatatatgtatatatatatacacacacacatacacaccagccttacaaagagctactaacccttttccccaaggaaaagtctcagtctgggccactttaagaagaaagatttcccatttttaactctctagagatgtaccagggcctggaaaatccctctctgccttgggggagttttatgtacaatttgcatgtattcaggtttcacacagaagccagcatccaaacccaagccaaaccctggaaaatagctgctaaattgacccaggatcctccgtccttcagacaggcctcccagcagaccccctcttcctgtggactctggggtgagggatgactgagccctcatggccaaaggagaagcttctggggaactgaggcagacggcagcccagtcaggcagagaccataggagcgacgggccctgtggttcgatcttactgtaactttttacattcttaaaaaacaaaaagcacaattccacatacacactgtctggaaagcacagccagacagccagcctagggcatctgagtccagaagaggcgctggggctttatctgttgcagggttcttgtattgttgtataatgtgctggtggtgactcaaggctcctcactttgtagggtggagagggagggagggagggcctgctgaggccattcctgacccccagggtgggctcatcagcatggacttggggcctggactcttgcccctgaagcagctctggcactttcaggcaccccagagcacaattgctacaccttccacgctagtctcatgcattgaggatttctgcactcggacctggccccaaaccctcttccccttccccttcttccctaaggaagctcccccttgctttacaaatcattttttatgctatctgttctctcaggagggggctagagcatgcgggacaagcctgcagggtttctcaaacaatacatctatttttctgagcagcattccaagagaggacttgaagggtgtttaaattaacgatgaataaaatgcagcctgcc

SEQ ID NO: 168150 - DNA, 2522 bp, Homo sapiens
  Payload ID: 13076
  Gene Symbol: KCNK13
  Gene Name: potassium channel, two pore domain subfamily K, member 13
  Uniprot ID: Q9HB14
  ENST ID: ENST00000282146
  CDS Start-End: 442-1668
cgggaaactcgagttggctcgagcttgccctgaagacgcgccacgccccctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccatagggtttgggatgacaactccggcgacagtaggaggaaaaatctttctgatcttttacggccttgttgggtgttccagcaccatcttgttcttcaacctcttcctggagcgcctgatcaccatcatcgcctacatcatgaagtcgtgccaccagcggcagctccggagacgaggggccctgccccaggagagcctgaaggatgcggggcagtgtgaggtggacagcctggccggctggaagccctccgtgtactacgtcatgctgatcctatgcacagcctccatcctcatctcttgctgcgcctcagccatgtacacccccattgaaggctggagctactttgactcactctacttctgttttgtggctttcagcaccattggctttggggacctggtcagcagccagaacgcccactatgagagccaaggcctctatcgctttgccaacttcgtcttcatcctcatgggtgtctgctgcatctactccttgttcaatgtcatctctatcctcatcaaacagtccttgaactggatcctgaggaaaatggacagcgggtgctgcccgcaatgccagagaggactcttgcgatcacgcaggaacgtggtgatgccaggcagcgtccggaaccgctgcaacatctccatagagacagacggggtggcagagagtgacacggacgggcgccggctctcaggggagatgatctccatgaaggacttgctggcagccaacaaggcctcgttggccatcctgcagaagcaactgtctgagatggccaacggctgcccccaccagaccagcacactggcccgggacaatgaattctcagggggggtgggagcctttgcaatcatgaacaacaggttggcagagaccagtggggacaggtagaagccaggagtggatgctgggcagaggccagagtagaatggaggatgattgccgcccaggggacgagctcagccctgcgccttggctctgttccttctgggagctgttcccgggagcctccgcaagcatctttagaaatctgatctcggctccaaccaacagccaccttccagggatggggggcctgaagcctcgatgcttgtctcctgatccttattctttaagtctaaattcagtcttttcaaaacaaatcacaaaagcagcattagacattgccttgtttcattaatcttgtttcagagctttagctgcctgaggagataggttttccttaagccttgatttcctgaagctctctctgttccttatttgggaacaaaaattgcgaagactcatctttccctagaactctgaatggatgaatttttaaaagtggggagaatgtttggggatgtgtctgggctttctttttgccaggcttccttcaaagcatacctgccaatggtgtctgcatagggaaaatgtctgttgtactctttatacctgtttctgttttttgttgtccctttctttttatttttaaggccttaatgcctggctgtggcgtctgtgagacctcaatgtaataagaaaattaaattcagcttcaggcctttaaactgcagcaagatggtggtgtaggggtgtgggacggggagagactcacttttgtaactaaagaacatagcttaacattttccctttgaatggtcacacagaccatttcatttttaccagggcttggggacccaatgcaaagatgatgactatttaataaaatggaaaatttaataaatcctcattttattaactaa

SEQ ID NO: 168151 - DNA, 2599 bp, Homo sapiens
  Payload ID: 13077
  Gene Symbol: KCNK15
  Gene Name: potassium channel, two pore domain subfamily K, member 15
  Uniprot ID: Q9H427
  ENST ID: ENST00000372861
  CDS Start-End: 132-1124
ggttcccggcagtcgccccgcctcgcccgtcacaaccctgccgcgtggggccggggttggagggggcggagcgcgcggtccgggcacacggagcaggttgggaccgcggcgggtaccggggccggggcgccatgcggaggccgagcgtgcgcgcggccgggctggtcctgtgcaccctgtgttacctgctggtgggcgctgctgtcttcgacgcgctcgagtccgaggcggaaagcggccgccagcgactgctggtccagaagcggggcgctctccggaggaagttcggcttctcggccgaggactaccgcgagctggagcgcctggcgctccaggctgagccccaccgcgccggccgccagtggaagttccccggctccttctacttcgccatcaccgtcatcactaccatcgagtacggccacgccgcgccgggtacggactccggcaaggtcttctgcatgttctacgcgctcctgggcatcccgctgacgctggtcactttccagagcctgggcgaacggctgaacgcggtggtgcggcgcctcctgttggcggccaagtgctgcctgggcctgcggtggacgtgcgtgtccacggagaacctggtggtggccgggctgctggcgtgtgccgccaccctggccctcggggccgtcgccttctcgcacttcgagggctggaccttcttccacgcctactactactgcttcatcaccctcaccaccatcggcttcggcgacttcgtggcactgcagagcggcgaggcgctgcagaggaagctcccctacgtggccttcagcttcctctacatcctcctggggctcacggtcattggcgccttcctcaacctggtggtcctgcgcttcctcgttgccagcgccgactggcccgagcgcgctgcccgcacccccagcccgcgccccccgggggcgcccgagagccgtggcctctggctgccccgccgcccggcccgctccgtgggctccgcctctgtcttctgccacgtgcacaagctggagaggtgcgcccgcgacaacctgggcttttcgcccccctcgagcccgggggtcgtgcgtggcgggcaggctcccaggcttggggcccggtggaagtccatctgacaaccccacccaggccagggtcgaatctggaatgggagggtctggcttcagctatcagggcaccctccccagggattggaaacggatgacgggcctctaggcggtcttctgccacgagcagtttctcattactgtctgtggctaagtcccctccctcctttccaaaaatatattacagtcacaccataagcacaaaccaggctccagggtcaccctgtaggagcaaattccttgtagtccaaattgtatgagggcgtggccacatcagcacttaggagaggctctgcacaggtccacctcagagccgaccctccagagcaacttttctgttgtgaagaggctggttttctgagtaacggttgaaatgtgcaactttcaacactggaatcttcgctgcaattagtgaggtcagatgctcacactacgagaagcatggggaacaaaggtggaccaaatgggaccgtgtacagtccagtgttgacaagggggtcaatctcttgcgctaaacgatctcattctctgcccagtgtatagagtggaatcagcccatgtgtgaatgatggcctctttcccccagacagctgatgctctttgtccctggccagccccacttcaggatgagggaggccttgctgtcacccacccaccatgtcactggggccacttggacacagcagaatgccatgggacgagctctcttccgggtcctgtcaatcaccagcaatatgaccttggagaatcgcatcctctcccagggcctcagtttccacatctgtagaatgacggggttcatccagaaccctgctccctcttacgcatctctggcaggactttctggaacaggcccctgcaccataagggggcagagacaaagcccgaggtgtggcatcctggcaccccgtggcactcagccacttcccctggcttcccagatagggctgtctcaacacaaagcatgaacgagccaggttagaaaagccaaaaactttaatttcaacatgagctacatggtcatgaacacaatgcaacgcgaccccactccaacccaagggccccagaaaccctccctccctaaaggcctgggcggctgctgctccaagagagggaatgagggaaaggtgggtggatggagagaggcccccagcctaaggacccaggctcctgccttcccaccacccgtccaggaagcagtcataaagtgaaagggctccagaggtgatgctcacagccctgggttcggctccattctgacctccctgaagcgctgggttagacgggcaccatcagcccacctcacaggctcggcgtcgggtgagctcgtggacgctaatgctttctgtccactctgaggtgctgctccagatgtggggccctcccagagggcctcggagacaccataggggaacagggagaggggctcggtccctgggcctgacacagcactgctgctcaataaataaatgcaggtgaccttg

SEQ ID NO: 168152 - DNA, 789 bp, Homo sapiens
  Payload ID: 13078
  Gene Symbol: KCNK16
  Gene Name: potassium channel, two pore domain subfamily K, member 16
  Uniprot ID: Q96T55
  ENST ID: ENST00000373227
  CDS Start-End: 1-789
atgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggtctgaggcaaggctgtggagccaaggcggctccaggcaggagacccaggagaggctctacagcagcaagaggagtccaagtcacaccccaggacttccccatatccaagaaaggactgggaagctga

SEQ ID NO: 168153 - DNA, 1248 bp, Homo sapiens
  Payload ID: 13078
  Gene Symbol: KCNK16
  Gene Name: potassium channel, two pore domain subfamily K, member 16
  Uniprot ID: Q96T55
  ENST ID: ENST00000373229
  CDS Start-End: 15-944
gtcctggccacagcatgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggcacagaccccagcaagcattatatctcagtgtatcggagcctggcagccatctggatcctcctgggcctggcgtggctggcgctgatcctcccactgggccccctgcttctgcacagatgctgccagctctggctgctcagtctgaggcaaggctgtggagccaaggcggctccaggcaggagacccaggagaggctctacagcagcaagaggagtccaagtcacaccccaggacttccccatatccaagaaaggactgggaagctgaggacccacggactcttcacacagcctagacgcttcctccactccaggtagagggatttcgggggccttctcagaagcaaggagtggacaagcctcttggttaaggctcctcttacctcccaagctcatggacaagtggcaatcagctggggtccctcttttggggtacaaaggaaaggacagaggtgtgggagacccaaggtggtcttgagattgacagacagcaagtccttggagatagcccccgagtccaagaacttaggcaggggccccaagacaataaagttggtctctactatctccta

SEQ ID NO: 168154 - DNA, 1272 bp, Homo sapiens
  Payload ID: 13078
  Gene Symbol: KCNK16
  Gene Name: potassium channel, two pore domain subfamily K, member 16
  Uniprot ID: Q96T55
  ENST ID: ENST00000425054
  CDS Start-End: 1-969
atgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggccacccccttaacttcatcactccctctgggctcctgccttctcaagagcctttccaaacaccccatgggaagccagagagccagcagatcccaggatccttccagaaagtgagctccatgaacgtctggcctctctcaggaatgcattctccaggtctggcctttcccctgccagactgcaacatccctgaccaggagagatttagaccactccatcccggggcctggaaattttggcctttgcctctcccatcatccaacagcaagtgggctcctatgtggctgggttcctctgcacaggtctgaggcaaggctgtggagccaaggcggctccaggcaggagacccaggagaggctctacagcagcaagaggagtccaagtcacaccccaggacttccccatatccaagaaaggactgggaagctgaggacccacggactcttcacacagcctagacgcttcctccactccaggtagagggatttcgggggccttctcagaagcaaggagtggacaagcctcttggttaaggctcctcttacctcccaagctcatggacaagtggcaatcagctggggtccctcttttggggtacaaaggaaaggaca

SEQ ID NO: 168155 - DNA, 981 bp, Homo sapiens
  Payload ID: 13078
  Gene Symbol: KCNK16
  Gene Name: potassium channel, two pore domain subfamily K, member 16
  Uniprot ID: Q96T55
  ENST ID: ENST00000437525
  CDS Start-End: 49-933
tctcccccatagccagccccacggccctggcagggtcctggccacagcatgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggcacagaccccagcaagcattatatctcagtgtatcggagcctggcagccatctggatcctcctgggcctggcgtggctggcgctgatcctcccactgggccccctgcttctgcacagatgctgccagctctggctgctcagtaggggcctcggcgtcaaggatggggcagcctctgaccccagtgggctccccaggcctcagaagatccccatctctgcatgaggcccccggggggggcccagaaacccctttcatcctccccagtcccac

SEQ ID NO: 168156 - DNA, 889 bp, Homo sapiens
  Payload ID: 13078
  Gene Symbol: KCNK16
  Gene Name: potassium channel, two pore domain subfamily K, member 16
  ENST ID: ENST00000507712
  CDS Start-End: 242-835
cagccttcaagggtgaagacgctgggggcggccgagagagcccactggggcctggacagagtgagcacacctatccgatttagcccagaaacatctatccaacttggagacagagagagagacatgaagcactcaggagaacctgctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggtctgaggcaaggctgtggagccaaggcggctccaggcaggagacccaggagaggctctacagcagcaagaggagtccaagtcacaccccaggacttccccatatccaagaaaggactgggaagctgaggacccacggactcttcacacagcctagacgcttcctccactccaggtagaggg

SEQ ID NO: 168157 - DNA, 1658 bp, Homo sapiens
  Payload ID: 13079
  Gene Symbol: KCNK17
  Gene Name: potassium channel, two pore domain subfamily K, member 17
  Uniprot ID: Q96T54
  ENST ID: ENST00000373231
  CDS Start-End: 234-1232
acacatttgaggcggggccagatgcccacagttcagagcctctttttgtcccggggattggatcccagggctgggtggggccaggctgtcccattccccaacactcctcctccccggcgaaaccgggcaccagcaggcgtttgcgagaggagatacgagctggacgcctggcccttccctcccaccgggtcctagtccaccgctcccggcgccggctccccgcctctcccgctatgtaccgaccgcgagcccgggcggctcccgagggcagggtccggggctgcgcggtgcccagcaccgtgctcctgctgctcgcctacctggcttacctggcgctgggcaccggcgtgttctggacgctggagggccgcgcggcgcaggactccagccgcagcttccagcgcgacaagtgggagctgttgcagaacttcacgtgtctggaccgcccggcgctggactcgctgatccgggatgtcgtccaagcatacaaaaacggagccagcctcctcagcaacaccaccagcatggggcgctgggagctcgtgggctccttcttcttttctgtgtccaccatcaccaccattggctatggcaacctgagccccaacacgatggctgcccgcctcttctgcatcttctttgcccttgtggggatcccactcaacctcgtggtgctcaaccgactggggcatctcatgcagcagggagtaaaccactgggccagcaggctggggggcacctggcaggatcctgacaaggcgcggtggctggcgggctctggcgccctcctctcgggcctcctgctcttcctgctgctgccaccgctgctcttctcccacatggagggctggagctacacagagggcttctacttcgccttcatcaccctcagcaccgtgggcttcggcgactacgtgattggaatgaacccctcccagaggtacccactgtggtacaagaacatggtgtccctgtggatcctctttgggatggcatggctggccttgatcatcaaactcatcctctcccagctggagacgccagggagggtatgttcctgctgccaccacagctctaaggaagacttcaagtcccaaagctggagacagggacctgaccgggagccagagtcccactccccacagcaaggatgctatccagagggacccatgggaatcatacagcatctggaaccttctgctcacgctgcaggctgtggcaaggacagctagttatactccattctttggtcgtcgtcctcggtagcaagacccctgattttaagctttgcacatgtccacccaaactaaagactacattttccatccaccctagaggctgggtgcagctatatgattaattctgcccaatagggtatacagagacatgtcctgggtgacatgggatgtgactttcgggtgtcggggcagcatgcccttctcccccacttccttactttagcgggctgcaatgccgccgatatgatggctgggagctctggcagccatacggcaccatgaagtagcggcaatgtttgagcggcacaataagataggaagagtctggatctctgatgatcacagagccatcctaacaaacggaatatcacccgacctcctttatgtgagagagaaataaacatcttatgtaaaatacca

SEQ ID NO: 168158 - DNA, 1706 bp, Homo sapiens
  Payload ID: 13079
  Gene Symbol: KCNK17
  Gene Name: potassium channel, two pore domain subfamily K, member 17
  Uniprot ID: Q96T54
  ENST ID: ENST00000453413
  CDS Start-End: 142-957
attccccaacactcctcctccccggcgaaaccgggcaccagcaggcgtttgcgagaggagatacgagctggacgcctggcccttccctcccaccgggtcctagtccaccgctcccggcgccggctccccgcctctcccgctatgtaccgaccgcgagcccgggcggctcccgagggcagggtccggggctgcgcggtgcccagcaccgtgctcctgctgctcgcctacctggcttacctggcgctgggcaccggcgtgttctggacgctggagggccgcgcggcgcaggactccagccgcagcttccagcgcgacaagtgggagctgttgcagaacttcacgtgtctggaccgcccggcgctggactcgctgatccgggatgtcgtccaagcatacaaaaacggagccagcctcctcagcaacaccaccagcatggggcgctgggagctcgtgggctccttcttcttttctgtgtccaccatcaccaccattggctatggcaacctgagccccaacacgatggctgcccgcctcttctgcatcttctttgcccttgtggggatcccactcaacctcgtggtgctcaaccgactggggcatctcatgcagcagggagtaaaccactgggccagcaggctggggggcacctggcaggatcctgacaaggcgcggtggctggcgggctctggcgccctcctctcgggcctcctgctcttcctgctgctgccaccgctgctcttctcccacatggagggctggagctacacagagggcttctacttcgccttcatcaccctcagcaccgtgggcttcggcgactacgtgattgcaagctgcctcatttcagatacgagaaaaccaaacagagactggcaaacactagagcggacatcgaaatcctctgggggcttgttaaaatacagatttctggccgggcacggtggctcacacctgtaattctaacactttgggaggccgaggaatgaacccctcccagaggtacccactgtggtacaagaacatggtgtccctgtggatcctctttgggatggcatggctggccttgatcatcaaactcatcctctcccagctggagacgccagggagggtatgttcctgctgccaccacagctctaaggaagacttcaagtcccaaagctggagacagggacctgaccgggagccagagtcccactccccacagcaaggatgctatccagagggacccatgggaatcatacagcatctggaaccttctgctcacgctgcaggctgtggcaaggacagctagttatactccattctttggtcgtcgtcctcggtagcaagacccctgattttaagctttgcacatgtccacccaaactaaagactacattttccatccaccctagaggctgggtgcagctatatgattaattctgcccaatagggtatacagagacatgtcctgggtgacatgggatgtgactttcgggtgtcggggcagcatgcccttctcccccacttccttactttagcgggctgcaatgccgccgatatgatggctgggagctctggcagccatacggcaccatgaagtagcggcaatgtttgagcggcacaataagataggaagagtctggatctctgatgatcacagagccatcctaacaaacggaatatcacccgacctcctttatgtgagagagaaataaacatcttat

SEQ ID NO: 168159 - DNA, 1155 bp, Homo sapiens
  Payload ID: 13080
  Gene Symbol: KCNK18
  Gene Name: potassium channel, two pore domain subfamily K, member 18
  Uniprot ID: Q7Z418
  ENST ID: ENST00000334549
  CDS Start-End: 1-1155
atggaggtctcggggcacccccaggccaggagatgctgcccagaggccctgggaaagctcttccctggcctctgcttcctctgctttctggtgacctacgccctggtgggtgctgtggtcttctctgccattgaggacggccaggtcctggtggcagcagatgatggagagtttgagaagttcttggaggagctctgcagaatcttgaactgcagtgaaacagtggtggaagacagaaaacaggatctccaggggcatctgcagaaggtgaagcctcagtggtttaacaggaccacacactggtccttcctgagctcgctctttttctgctgcacggtgttcagcaccgtgggctatggctacatctaccccgtcaccaggcttggcaagtacttgtgcatgctctatgctctctttggtatccccctgatgttcctcgttctcacggacacaggcgacatcctggcaaccatcttatctacatcttataatcggttccgaaaattccctttctttacccgccccctcctctccaagtggtgccccaaatctctcttcaagaaaaaaccggaccccaagcccgcagatgaagctgtccctcagatcatcatcagtgctgaagagcttccaggccccaaacttggcacatgtccttcacgcccaagctgcagcatggagctgtttgagagatctcatgcgctagagaaacagaacacactgcaactgcccccacaagccatggagaggagtaactcgtgtcccgaactggtgttgggaagactctcatactccatcatcagcaacctggatgaagttggacagcaggtggagaggttggacatccccctccccatcattgcccttattgtttttgcctacatttcctgtgcagctgccatcctccccttctgggagacacagttggatttcgagaatgccttctatttctgctttgtcacactcaccaccattgggtttggggatactgttttagaacaccctaacttcttcctgttcttctccatttatatcatcgttggaatggagattgtgttcattgctttcaagttggtgcaaaacaggctgattgacatatacaaaaatgttatgctattctttgcaaaagggaagttttaccaccttgttaaaaagtga

SEQ ID NO: 168160 - DNA, 1491 bp, Homo sapiens
  Payload ID: 13081
  Gene Symbol: KCNK2
  Gene Name: potassium channel, two pore domain subfamily K, member 2
  Uniprot ID: O95069
  ENST ID: ENST00000391894
  CDS Start-End: 184-1419
ggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaatggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggt

SEQ ID NO: 168161 - DNA, 1410 bp, Homo sapiens
  Payload ID: 13081
  Gene Symbol: KCNK2
  Gene Name: potassium channel, two pore domain subfamily K, member 2
  Uniprot ID: O95069
  ENST ID: ENST00000391895
  CDS Start-End: 68-1336
gaaaccttggaggaagaacggcattaaagatcaaaagcatgatgactcctgatgaaaacatcaccaaatgatgaacccacgagcaaaaagggatttctacttggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtag

SEQ ID NO: 168162 - DNA, 3379 bp, Homo sapiens
  Payload ID: 13081
  Gene Symbol: KCNK2
  Gene Name: potassium channel, two pore domain subfamily K, member 2
  Uniprot ID: O95069
  ENST ID: ENST00000444842
  CDS Start-End: 151-1431
ccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctctttccctaatgtgccataaggcctcagaatgaatgagaattgtttctggtaacaatgtagctttgagggatcagttcttaacttttcagggtctacctaactgagcctagatatggaccatttatggatgacaacaattttttttttgtaaatgacaagaaattcttatgcagccttttacctaagaaattttctgtcagtgccttatcttatgaagaaacagaacctctctagctaatgtgtggtttctccttccctgcccccacccctaggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaaaatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagcttctaattgctttttgatgtatgaaaggcttatataattttcttttcgttgggtgacttttgccagatgagaggaggtggcacagtggtgagtgcagggcacagtcctagccttctgtgggtatacttttggagttgtgacttggctgtgagggcagaagttgaagttgggatcactgtgactttgcacatggaaaaatgcagattgcaggcataattcatctctgacattagagaaaaagctgttatagcacaatttaaattttgagagtttgctgtgtttttttttcacataaaagaggctgattattctttttagtttaattttatatcctgtaattctttggatggttccaagattcagaaaaaattcagtaaatgcaccccgtaaattgctaccctttcctttattttcatacttagatctgctgtacattgtatatatatataatttttaaaatgcagaaagaaaataatttccctaaatataattgcaaactgatttcttttacttttttgtgtgtgggggtgggagctgtatctgaataagtggcattcagattagggtcttgaaaaataaacccagaatctttaaaagaagcaaataaactaatagacgcttattttccaaaatttaaatttaagctagaaatgtaaatattcaattaatttgttaaaagtacttttataaagttaaaaaaaatccaaccaaaattttagaaagtcaggctcttttagaaagaaagctacacccatttcctcaaataactgttccgaaaatttatatggtggaatgcgccatgtataaactgtgaattgtattgacaaataaagtttgtaattaaagtcagca

SEQ ID NO: 168163 - DNA, 644 bp, Homo sapiens
  Payload ID: 13081
  Gene Symbol: KCNK2
  Gene Name: potassium channel, two pore domain subfamily K, member 2
  ENST ID: ENST00000457122
  CDS Start-End: 271-644
tctcagcaagcggccgtttcccatcttcgcttcgcgtccaaagtgttgggtcataatctggatttggaggcaaacccttgccagatcctctccacgccgcttctcccccctctcccgccggtgcccggggtttttgcatctgcctgagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactggg

SEQ ID NO: 168164 - DNA, 1662 bp, Homo sapiens
  Payload ID: 13081
  Gene Symbol: KCNK2
  Gene Name: potassium channel, two pore domain subfamily K, member 2
  ENST ID: ENST00000486921
  CDS Start-End: 148-606
aacattcacacacaaaaaggaaacagtatgggacgatggcttgttagtacaagtgactctgttttggaaattacggacaagaaaccttggaggaagaacggcattaaagatcaaaagcatgatgactcctgatgaaaacatcaccaaatgatgaacccacgagcaaaaagggatttctacttggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcaggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactat

SEQ ID NO: 168165 - DNA, 961 bp, Homo sapiens
  Payload ID: 13081
  Gene Symbol: KCNK2
  Gene Name: potassium channel, two pore domain subfamily K, member 2
  ENST ID: ENST00000470177
  CDS Start-End: 152-622
accttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcaggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagatt

SEQ ID NO: 168166 - DNA, 1200 bp, Homo sapiens
  Payload ID: 13081
  Gene Symbol: KCNK2
  Gene Name: potassium channel, two pore domain subfamily K, member 2
  Uniprot ID: O95069
  ENST ID: ENST00000467031
  CDS Start-End: 73-759
gacaagaaaccttggaggaagaacggcattaaagatcaaaagcatgatgactcctgatgaaaacatcaccaaatgatgaacccacgagcaaaaagggatttctacttggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattgtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttct

SEQ ID NO: 168167 - DNA, 1130 bp, Homo sapiens
  Payload ID: 13081
  Gene Symbol: KCNK2
  Gene Name: potassium channel, two pore domain subfamily K, member 2
  ENST ID: ENST00000474771
  CDS Start-End: 73-726
accttgtaaaacaaagccggggaaaatgcctgcccgtgcagctcggagcgcgcagcccgtctctgaataagaatggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattgtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctt

SEQ ID NO: 168168 - DNA, 566 bp, Homo sapiens
  Payload ID: 13081
  Gene Symbol: KCNK2
  Gene Name: potassium channel, two pore domain subfamily K, member 2
  ENST ID: ENST00000478774
  CDS Start-End: 213-566
gtgttgttagagaattcgcctattacgacgacagcaacgtctgatctcctggctttcttcccctccttgatgtcttcgccctggctccagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgt

SEQ ID NO: 168169 - DNA, 6162 bp, Homo sapiens
  Payload ID: 13082
  Gene Symbol: KCNK3
  Gene Name: potassium channel, two pore domain subfamily K, member 3
  Uniprot ID: O14649
  ENST ID: ENST00000302909
  CDS Start-End: 126-1310
tgcccggcgcggagagcggcgagcgcagccatgccccaggccgcctccggggcagcagcagcggcggccggggccgaggcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgaggggcctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttcaagctaactggcctccagccacattctcatagcaggtaggacttcagccttccagacactgcccttagaatctggaacagaagacttcagactcaccataattgctgataattacccactcttaaatttgtcgagtgatttttagcctctgaaaactctatgctggccactgattcctttgagtctcacaaaaccctacttaggtcatcagggcaggagttctcactcccattttacagatgagaatactgaggcctggacaggtgaagtgaccagagagcaaaaggcaaaggggtgggggctgggtgcagtggctcacacctgtattcccaacacttttggaggctgaggttggaggattgcttgagcccaggaatttgagaccagcctaggtgacatagtgagaccccatctctacaaaaaataaaaaattaaccaggtgtggtggcacgtgcctgggagtcccagcgacttgggaggctgaggtgggaggattgtttgagcctgggaggtcgaggctgtagtgagccctgattgcaccactgtactccagcctgggtgacagggcaagaccctgtctcaaaaaaaaaaaaaaaaatggcaaagggagacaagagcccagcctgcttgttgctagccaaagtgttctttccttccagcttggcctgctcttaaaagcaaagctcctgcagtgtacatcctggcattgtgtggctacctgggttttaaaccagaatcagaagtcccggatcagagggcactgctgaggttcagcctcttctcttcttggccaggaggcagcagctctgaatgggcccctgaggctgcacaggggcctttgtcactggggcgcatgcttacaaacagtgcagttcttgggaccgaggtaagcagggctgggtctcatggcagaaaggccaggatctggggctctaggaatttgggaattgggcagagtggccaagaaagctggcaggcatatcctatgggacatcacacctggcaccattgtcattgttggtgcctgtgtcccaagtagctagtgataagctgaggctgcagcaagaaacacccttcccaggtgggggagtttggaccagaggtgccctctgcccaccacacctgcaacccagaagcccagatggaacgcagctgacgaaggtgatgcttgaggctcacttttggggccccacagctggagccggtataatgactgggacaacatcaaggggtggatgaggggcctctcctcccgcaacactgccttcccatgctgttcccctgccagctccttaacactgccgaccaaggccagccctggcattcagggaaattggagggcagcacccgtagggtggccagcctcaggccccaccccagctgtgtcctctagtctctggggacccctggggggaagaagtctaccctgcttgtgagtcccgtctcagtgtggaggaactggctgcacgtgggacctgaaggtgccctctgtgtttatgttgggggtgggggggcagtgctggctgcctctgtcctgtgtgtgaccctgccctcgaagggtcctgtcctgtcagtcccgagggagccacaaccaaagctgcggagagaaggtggggaagggtgcagaatggccgtggggcacagcgtggcagactgttcagtctctgctgggtctttcctagggacctggaaggccagtgttgcttccccctcactccctttcactgcaggcagcctctctgcttccccaatgccttatgcctgggcacactgccacagaatatgcaatatgtgtgggtgaccatgccctcacgaccacacccccaccccgggcagcccccggactccaaaggtcgtggctgccacagcctccctcagctcttcctgcctatctgtcttcacactgagaatggcgcccaataaatgctatccacggagaccaggctcaggctccagctgcctctgtcatcgtatgcccttgctgctgccagggaggggccatctcccaccccctcccctgccggggtctacaaacatatctagctgctgggtgccgtggctcacacctatagtcacagcactaggcgggcagatcacctgaggtcagaagttcaagaccagcctggccaacatggtaaaaccccgtctctactaaaaatacaaaaattagctgagcgtggtggcgcatgtctgtagtcccagctactcggctactcaggaggctgacgcacgagaatcgcttgaacccgggaggcggaggttgcagtgagctgagatcgtgccactgcactccagcctgagcgacagagtgagaccctgtctaaaaaaaaacaataataataaaataaaataacatacctagctgactcgccatgggctcgctggcctgtgggcgacactggcttcccttttgggatttcccagaagatccagattttcttaagtccccttggaacagactaagaaaggatcaccttagaaatcacctggtcctattgtcccccccgtacatgagtaactgaggcccacagagagcaaatcgcctgcctgagtcacacagcagtgagtggcagacctaggctaggaactaggactggggattgctattccagtgctccccatcctcacacagactgcacagtccgcctggacacaccccagctgacagtggtacctcccagtcagccaggagaatggattccttctcctgcagtaggggccccctggctgagtggcctgattgactaaaacatatgtctttgaaggagagtgcatcacaagcacctttctttggggtagatttttctctgggtctagagggacagctcaggcttgggactgggcctcagaacctacgacagaccgtgagagcagacccaccttatccatctggtgccagctccccaggtcagctacagcgacccccggacttcatagagtacaatccacagtaatagcacacagctctgtacctatctagctccatgcctatctatctgcctacctttcacaaaataattcttagcaaccctgctacagccaatgattctaatacgttctgttctattgcatgttataaaatgctggtcacgatccactaaattgatgtctctacctgctaatggtttaatacctgcagattgaaatatactggagaaataaagagagtgggagtagggacactttctcccagtgcccacaccgcccctcgttacccgcataggtcaactgaaagatacagagagggaagctttgatggggggttcagagttcaaaggaagaaatgatggcacctgcactccctgcccccagaggcaggacacagccagccctcctgtgacagcactcctggcagctccttgttggcctgcagccctcagggggcttagttgccattgactcacccactcctaaggccaccacatcaaaatctgaggcttactgccctgtcccacctgcctctgtctttcttaaaacagctaaatgcaacaatagcagaaattagcttgtttttgaggttggcaatgaccagttcaaggtgactcttattttcttaagcagtgcttgcaggacataaatgtgatgacacttgccctcctttctttatcgcctgggacagactttacaaacagacctgggagaagtcccctaaggggctgcatttatccccatctccctaggggtgatcagcattgtgacagctgggcagagcagtggtgaactgcacccatgtccctgctcacatctcctaagatctcagaattgcctgaggttctagcgtgggctccttctctccagatgatgccatccccacccccctcatttccacacagcatctgaggcatcctgcactaaaagatatatgtacagcaaaacaaaaatagaaaaccagcacagcagagtggaggtggggtataaatatacccagatccccgctgatttggttactcggggtgagcatcagatggaaatagaagtttccgggggccaagagagaaagagggatgtaacgacaattcttttcaaaacgtgtcccatggtatgcctcgtggaaaaaatggttcgttggtcaaatgaatttgggaaaatgctgtcaatatcaccgactcatggagcttcgcaaggcatcttagcttaataaaggttatgaaaagtcttgcagcaaa

SEQ ID NO: 168170 - DNA, 1956 bp, Homo sapiens
  Payload ID: 13082
  Gene Symbol: KCNK3
  Gene Name: potassium channel, two pore domain subfamily K, member 3
  ENST ID: ENST00000620977
  CDS Start-End: 454-1269
tggtgctgaagggacagctccgcggcggcggcggcggcggcggccccgggcgctgagcgggtgcccggcgcggagagcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgaggggcctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttca

SEQ ID NO: 168171 - DNA, 1673 bp, Homo sapiens
  Payload ID: 13083
  Gene Symbol: KCNK4
  Gene Name: potassium channel, two pore domain subfamily K, member 4
  Uniprot ID: Q9NYG8
  ENST ID: ENST00000394525
  CDS Start-End: 187-1368
gtgcacgctagtgtccacacacgtgtgcgtgggctctgggtgccctggcgcggccggcacgcccatgggggccggggatgccggggcgtctgcggagagtgcaggtgggtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccgga

SEQ ID NO: 168172 - DNA, 1697 bp, Homo sapiens
  Payload ID: 13083
  Gene Symbol: KCNK4
  Gene Name: potassium channel, two pore domain subfamily K, member 4
  Uniprot ID: Q9NYG8
  ENST ID: ENST00000422670
  CDS Start-End: 236-1417
agagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgca

SEQ ID NO: 168173 - DNA, 1450 bp, Homo sapiens
  Payload ID: 13083
  Gene Symbol: KCNK4
  Gene Name: potassium channel, two pore domain subfamily K, member 4
  ENST ID: ENST00000541349
  CDS Start-End: 132-608
cggcgaggccgtgctggaacccgggcctcagccgcagccgcagcggggccgacatgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgct

SEQ ID NO: 168174 - DNA, 1723 bp, Homo sapiens
  Payload ID: 13083
  Gene Symbol: KCNK4
  Gene Name: potassium channel, two pore domain subfamily K, member 4
  Uniprot ID: Q9NYG8
  ENST ID: ENST00000539216
  CDS Start-End: 361-1542
caggcttaggctctctttcggcctcccactcgccttcctttcccttctcggtgccctcctctctttcctcacccggtagtcccagacaggggctgagggccgggcagcggaggtaaggggaaggctggagataggagggggactgggtgtgtccagccagagggatgtctgtggacagtgcagctgggggctttatggatctttgggtgtgtaggggatagaggaggagggtgtgggtgtcaggccagctcagtgaccccagcatccctggttttgcccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccc

SEQ ID NO: 168175 - DNA, 1389 bp, Homo sapiens
  Payload ID: 13083
  Gene Symbol: KCNK4
  Gene Name: potassium channel, two pore domain subfamily K, member 4
  ENST ID: ENST00000538767
  CDS Start-End: 253-1185
tgtccccaggggcggagagttgcggacccttcccgatccggtaatgggcctgggagatgccagattagcgtggtgcctgtccggagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctccc

SEQ ID NO: 168176 - DNA, 3756 bp, Homo sapiens
  Payload ID: 13084
  Gene Symbol: KCNK5
  Gene Name: potassium channel, two pore domain subfamily K, member 5
  Uniprot ID: O95279
  ENST ID: ENST00000359534
  CDS Start-End: 340-1839
agcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggc

SEQ ID NO: 168177 - DNA, 5722 bp, Homo sapiens
  Payload ID: 13085
  Gene Symbol: KCNK6
  Gene Name: potassium channel, two pore domain subfamily K, member 6
  Uniprot ID: Q9Y257
  ENST ID: ENST00000263372
  CDS Start-End: 108-1049
tgccgcgcctgtagcactcccggaactggaactaggtgccagacggtccggaggcgggggccacgtcagcggggccacccagggctcgcggggtcccggtgggtgccatgcggaggggcgcgcttctggcgggcgccttggccgcgtacgccgcgtacctggtgctgggcgcgctgttggtggcgcggctggaggggccgcacgaagccaggctccgagccgagctggagacgctgcgggcgcagctgcttcagcgcagcccgtgtgtggctgcccccgccctggacgccttcgtggagcgagtgctggcggccggacggctggggcgggtcgtgcttgctaacgcttcggggtccgccaacgcctcggaccccgcctgggacttcgcctctgctctcttcttcgccagcacgctgatcaccaccgtgggctatgggtacacaacgccactgactgatgcgggcaaggccttctccatcgcctttgcgctcctgggcgtgccgaccaccatgctgctgctgaccgcctcagcccagcgcctgtcactgctgctgactcacgtgcccctgtcttggctgagcatgcgttggggctgggacccccggcgggcggcctgctggcacttggtggccctgttgggggtcgtagtgaccgtctgctttctggtgccggctgtgatctttgcccacctcgaggaggcctggagcttcttggatgccttctacttctgctttatctctctgtccaccatcggcctgggcgactacgtgcccggggaggcccctggccagccctaccgggccctctacaaggtgctggtcacagtctacctcttcctgggcctggtggccatggtgctggtgctgcagaccttccgccacgtgtccgacctccacggcctcacggagctcatcctgctgccccctccgtgccctgccagtttcaatgcggatgaggacgatcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcaggtgatcttgaggccttgccgtccaccgtctctcctttgtttcccagcatctggctgggatgtgaagggcagcactccctgtccccatgtcccgggctccactgggcaccaacataaccttgttctctgtcctttctctcatcctctttacactgtgtctctctggctctctggcattctcgctgcctctgtctttccctcttgctgtctctgtttctcattctctttcatgttccgtctgtgtctctcaattaaccactcgtcaactgctgattctactgggctgtgggctcagacctcatttcaggcaccagattggtcgctacaccctggacaagtgactgcccgtctctgagccttgatttcctcagctgccaaatgggaagaatagaagaatttgcccctaaacccctcctgtgtgctggccctgtgctagacagtgctggagacatagttgggggtggagaactgcccttatggagcttgcagtccagtgaggtggacagacctgtccccagacagtgatggcccaaaatggtcaggactttaatggaggaggtgaggtgttgaaagcacaggcagagtggtcagggctgaagtcggagaagcatagggactaggcccaatccagcctggaaagtcagggaggacttcctagaggaagggacatcgaactaagacctgaactatgagaaataggcaggaagaagttgtacctgactcatttttctcaggtgtctccagggagcaggacccatggagggacccctggtgtaggcctgggcgatagactcttcctcagcagcctggcaggcaggaaacagacataggaccccagcccagatctgaatggcatgggaggtgctgcccttaaccatgacaccattgtaagagctgtccacatttgtatgttgtgccctggaatcagcctggttgagctcaaatcccaacttagccacgtctggcctgtgtccttgggcagtcacactacctctctgattttgtttccttatctgtaaaatggtgatcatcataatacaacttcaaaaggatttcaggctgagtgtggtggctcacgcctatacacccagcactttggaaggctgaggaaggaggatcgcttgaggccaggagtttgagactagcctaggcaacacagtgaggccttatctcaacaacaaccacaaaatctaaaaattagctgggtgtggtggtgcatgcctgtgatcctggctacttcagaggctgaggtggaaggatcacttgaggccaggagtttgaggctgcagtgagttatgatggcactgctgcactccagcctgcgggacagagtgagaccctgtctgaaagaaagagagaaagaaagaaagaaagagagagaaagaaagaaagaaagaaagggaaagatggaaggaaggaaggaaaaagaaagagaaagagagagagagagaaagaaaaagaaagaaaagtaagaaagaaaaaagaaaaagaaagaaaagtaagaaagaaaaaaagaaaaagaaagaaagtaagtcctggctaacacggtgaaaccctgtctctactaaaaatacaaaaaattagccaggcgaggtggcaggcgcctgtagtcccagctactcgggaggctgaggcaggagaatggcgtgaaccccggtgggggcggagcctgcaatgagccgagatcgcgccactgcatccaacctgggtgacagcaagactccgtctcaaaaaaaaaaaagaaagaaagaaaagaaaagaaggaaagaagcggggcacagtggctcagtcctgtaatcccagcaccttgggaaggccaaggtgggaagatcacttgaggctaggagtttgagacaagcctggccaacatagcaagaccccatctctacaaaaataaaaattttaaaaagggctggggcatttgagctgggtcccaacagtagacaagtagaaaaggcatggagagggcataccaggtgggaggagctgtgtgcaaaggcctggagatggaaaagcatgctggccaccagcttctgacaagcagtttagtatgaacggtatgcagggaaagagggaaggagggcagaggggtgcgcacgagcacccgttagtgtccttaaatgaccagcatgggaacctggtctctttcctgagggccctagagagccatggaagggtttagagtaggagtgggtcatggttaggtttgggttttaggatgatccccctagttgctctggagaggtggagcagagcgggtactgaggctgggtgcctgtgggaggctgaggcaggaatgaagagggagacgatgggcctgggctgagccatggaagggaggaggggtgagtgcgggcacactcaggagccaagtggacaggccatagcccccacagactggagggacgcggctagggaatgtcccacagagtggccagttatccctgagagaaagagcaggttttagcggagacgctgaggctgctttagaatatggtgggtgtgtggggcaaaagggacacccaggggtgtatcaagaggtcatagggggcaggccaggtggctcacgcctgtaatcccagcactttgtgaggccgaggcaggtggatcacctgaggtcaggagttcaagaccagcctggccaacatggtgaaaccccgtctctactaaaaatacaaaaattagctgggtgtggtggcacatgcctgtagtcccagctacttgggaggctgagacagaattgcttgaacctgggaggtggcggctgcagtgggccgagatcacaccactgtactccagcctgggcgaaacagagactctgtctcaaaaaaaaaaaaaaagtcataggggctgggcatagtggctctcacctataatcctagcaaatcgtagtactttgggaggccgaggcaggaggattgcctgagcccaggggttcaagaccagcctcagcaacataaaatacaaaaaatacaaaaattagctgggtttggtggtgtgcacctgtggtcccagctactcaggaggctgaagtgggaggatcacttgagcctgggaggtcaaggctgcagtgagctgtgattgcatcactgtactccagcttgggtgacagagcaagaccctgtctcaaaaaaaaaaaaagaaaagaaaaagaaaaagaaaaagaaaatatgtatattggatatactatgtgccaggcacgattccaagcccctgatacattctctacattttacagatgggggaaggaggtccagagatgttaaatacttgcccaaggtcacacagaaagtggaacactgggatttgaacaaggttttggttgggcatcttttcctatgggagctcagaaatatctgttgtctagccctttctcagcctcccaaccttctcggttccttacctatgtcacagctgactttgagctaaagtcatctcggggcagctaggtgcctatgtgagctggcgttcatttctcactgtttctccttccaaatacctccaggaagaaaagcaagtcctttttggtccaagacattaaaaaagccaggctcagcggctcatgcctgtaatcccaacacttggggaggctgaggcaggaggatcgcttgagcccgggagctggagaccagcctggacatgttaacatagcaagacccctctacagaaaatgttaaaaatgagctgggtgtggtggcgcacacctgtagtcccagttactcaggaggatgaggcaggaggatcacttgagcctaggaggttgaggctgcagtgagccatgatcacactactggactccagcctgggccatagagcaagaccctgtcctaggagaaaaaaaagggccaggcacagtggctcacgcctgtaattccagtactttgggaggccgaggcgggcggatcacaaggtcaggagatcaagaccatcctggctaacacagtgaaacccgtctctactaaaaatacaaaaaaattagctgggtgcggtggcacgcacctgtgatcccagctactcgggaggctgaggcaggagaatcacttgaacccaggaggtggaggttgcagtgagccgagatcccaccattgcactccagcctgggagacagagcgagactccgtctcagaaaaaaaaaaaaaagaaaaaagtgtgtgctaaaaaattcatcaggtactaaagagtgtacggtggaaagtaagtctttctcctacactcagatcatggatggatgtctcaggtcttcccaggcacatttgatgttatgtaccagccatatgcatgtgtgtgtcatttatttttcactctacacaagtagtacctaatatggtgaggttgttatgattacagactctggaggcaaagttcctgggtataaatctgaactctgtcactcccaagctaagtggctttgggcaagtgatttcacctccatgtgcctcagtttgctagtctgtacaatgggatggtaatagcacctacctcatggacttgagaagtcagcaacttcatacctctaaagcccttagagctagcagtgtgtggcactcaataaaatgttgactaatgatgattctca

SEQ ID NO: 168178 - DNA, 1283 bp, Homo sapiens
  Payload ID: 13086
  Gene Symbol: KCNK7
  Gene Name: potassium channel, two pore domain subfamily K, member 7
  Uniprot ID: Q9Y2U2
  ENST ID: ENST00000342202
  CDS Start-End: 37-795
gagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtggagggacctcactccagggcacggcgtgggaggggtagtcgaagagctctggtggcagcgttgagaagggggtgagtggtgccagttgccagggcaagtcactgcgctgggaggtgggcggggagcatcaccagaacccaggcgctgccccagcaccttctcctccccaggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcataaaatgagcaacga

SEQ ID NO: 168179 - DNA, 1298 bp, Homo sapiens
  Payload ID: 13086
  Gene Symbol: KCNK7
  Gene Name: potassium channel, two pore domain subfamily K, member 7
  Uniprot ID: Q9Y2U2
  ENST ID: ENST00000340313
  CDS Start-End: 225-1148
atccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcataaaatgagcaacga

SEQ ID NO: 168180 - DNA, 1563 bp, Homo sapiens
  Payload ID: 13086
  Gene Symbol: KCNK7
  Gene Name: potassium channel, two pore domain subfamily K, member 7
  Uniprot ID: Q9Y2U2
  ENST ID: ENST00000394216
  CDS Start-End: 225-998
atccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtaagtccagccacctaacagcgtgtgggggaagggggaagaggagcctggactaggactcccataaatcactggggggctgggccttgcaggtggagggacctcactccagggcacggcgtgggaggggtagtcgaagagctctggtggcagcgttgagaagggggtgagtggtgccagttgccagggcaagtcactgcgctgggaggtgggcggggagcatcaccagaacccaggcgctgccccagcaccttctcctccccaggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcataaaatgagcaacga

SEQ ID NO: 168181 - DNA, 1372 bp, Homo sapiens
  Payload ID: 13086
  Gene Symbol: KCNK7
  Gene Name: potassium channel, two pore domain subfamily K, member 7
  Uniprot ID: Q9Y2U2
  ENST ID: ENST00000394217
  CDS Start-End: 225-983
atccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtggagggacctcactccagggcacggcgtgggaggggtagtcgaagagctctggtggcagcgttgagaagggggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcataaaatgagcaacga

SEQ ID NO: 168182 - DNA, 356 bp, Homo sapiens
  Payload ID: 13086
  Gene Symbol: KCNK7
  Gene Name: potassium channel, two pore domain subfamily K, member 7
  ENST ID: ENST00000530380
  CDS Start-End: 1-217
ccacctgggccagctcgcacttcttggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcataaa

SEQ ID NO: 168183 - DNA, 445 bp, Homo sapiens
  Payload ID: 13086
  Gene Symbol: KCNK7
  Gene Name: potassium channel, two pore domain subfamily K, member 7
  ENST ID: ENST00000525254
  CDS Start-End: 1-85
cctgcaccccgtgatttaccacctgggccagctcgcacttcttggtggagggacctcactccagggcacggcgtgggaggggtagtcgaagagctctggtggcagcgttgagaagggggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcat

SEQ ID NO: 168184 - DNA, 1245 bp, Homo sapiens
  Payload ID: 13087
  Gene Symbol: KCNK9
  Gene Name: potassium channel, two pore domain subfamily K, member 9
  Uniprot ID: Q9NPC2
  ENST ID: ENST00000303015
  CDS Start-End: 7-1131
gcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggggaactaactgcacattcaagagaggcgtccgtggatgctgggtctcactgccaaagccgaacacggcttcgggatttctgccttctcaagtggacctctgctgtgctgggcg

SEQ ID NO: 168185 - DNA, 3276 bp, Homo sapiens
  Payload ID: 13087
  Gene Symbol: KCNK9
  Gene Name: potassium channel, two pore domain subfamily K, member 9
  Uniprot ID: Q9NPC2
  ENST ID: ENST00000522317
  CDS Start-End: 50-1174
ctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggggaactaactgcacattcaagagaggcgtccgtggatgctgggtctcactgccaaagccgaacacggcttcgggatttctgccttctcaagtggacctctgctgtgctgggcgaatgctctactcattcccctacacaactgtggggatggtccagctacacatagacaggaagcccagagaaacgctcgatgtgagggtccccgcaagcccgtcgggctctttcggcacctggcccccccaaagctcctcaacgaggagtagagactgccaagcccttccactcattcatcatcataaaaatgtaacttgctatggcagcctcttggccattaagggctatactttgtgacctctgtccttgagatctttgctctgacaagttctatagccttctcagtgctgctatcgtgacgcagtgtccctgctgtggctaagtaacctttcgttttgatcaagatttgtccacgcagactcctacctctgcgcctttgcccgtgccgttcccactacctggaaggtctccccgttgctctccagctttgaggtggagacagagcatctcacacttccttttggtgtctcctgacccttttgctccctgctggacttggcgatgtcctcttctgggctcccctagtccttgttttggttgtgagcgaccgcaccagggagcaaaccttctatggccccggccacaggagcagcaagcactgggcagtgccccagacggaaggaccatcgcgagaataaaggcactgagatgtctggcatcttgcccaaatggccacttatcaccgtgattgaggcacgtcttaacttgctgaagtggaaacagggtaactcaatgcacgcctctgcaccatccctggaaaccaatccagatctatgagaagaaaactggtcatcatagcactggtgattcaacggcacctgcctggcagggtggagtgtgccccatacaacagggctggaagctgccacgccaggtatttctcataaggccggtacagggatggcaccagactatgggagcatacttgtgatgtcactctgaagaagttgggccccgtgatgggaatgtcatcaggaaactgggtccacactgttttcttgtggcaacacttctggtggaggctgcgaggggatggggacatgcaccatgagtgactcaggaacccccagcctctgtggcctggctcctgcccacccctagctctggggccttgagagaggcaagcacacgctcttctcgcctccagagagcggcgtgggggtgtggatactgctcaggccctggcatctcgcacgcctaggaccagcctctgccattcacaggaccgtgcaggcggccccaacagaggacggggacagctctctccttctgtaagtgaggcagcctcatccttccctggatcctcagcatctcttaaccagcagtggcagaggttgaattagaatggcaccagcttcggataaaaatccagatctcgcttttcaaaatgtgtctagagctggtggctgtaaggaaccagtcaagcctcagctgtgactctaatcctgccaagtccacctgagagccgactcattcatccaaagagagaacggtttggatggagctcaaggtgcctggctcgctggcatagcccagacaacctcttaaaggccgggccacagagctagaaggtctgtcactactcagttggggaaatcgtctgagaagttcaagtccactgcctcgcaactcaaatgagtcagcctcaccaaccaagaatcgcgttcataaacagactcagagcctgcgtgccgtggggtttccccgtctgcaactctctcacctggccctcctgcagggcccggcggggactggggagggtcagtgctccctggggcggggactgggtctgtttccaggctcagtgcctctgagtcatacagatgccaggtggtcctgctgcttaccctcgctgaacctcaggcttctcgtgtaaacagggcgcttttgaggaattattattaacatctccctgtgagtcaaagcacctactgagataatgtatgtgatgcttgtaataaatgcagctacatgccaggcactctga

SEQ ID NO: 168186 - DNA, 1441 bp, Homo sapiens
  Payload ID: 13087
  Gene Symbol: KCNK9
  Gene Name: potassium channel, two pore domain subfamily K, member 9
  Uniprot ID: Q9NPC2
  ENST ID: ENST00000520439
  CDS Start-End: 65-1189
gtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggtgtggggagggaaatgggacagaaaagtcatttgtcatagttggtgttaatttccattggtccaactcgtcttttcttatttatttattattattattgtcatcattattactttctctccttcctcctttcttggtctcttggtctcattttcccccacctttccagccagacagagcaggccaaagggaaatacaggcccatcctcctctgaaactcacatctgagcatgaagcatggatctcctcctt

SEQ ID NO: 168187 - DNA, 7964 bp, Homo sapiens
  Payload ID: 13088
  Gene Symbol: KCNH1
  Gene Name: potassium channel, voltage gated eag related subfamily H, member 1
  Uniprot ID: O95259
  ENST ID: ENST00000271751
  CDS Start-End: 29-2998
gcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgaggttagtgcctttatgggtgatccagggaagattggttttgctgatcagattccaccaccactggaggggagagagagtcagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacatatgtccacatgaccaacaattttcaagtaggcttttcctaacagaaaaagtggggccagtggcttagacgtgctctttctctatctggaaaaagatatgggaagggtagcgtgcccctaccctgcaaggtggcagctgcatctgaaccgtctttgcacaattttggaagaagggacatgctgtctaaagggtattttccttcatttttaattttttactaccatgatatttgtaaaagattaaaactaccagaacagagcagcagccatctggggactggtgggaaagtgccgagaacctctcatgtatatactatgctgggctcctttgccaagaccccccatggactgcagtgggccaaggacttcccggcatccccgtccttgtacagcccgtgtctgacgtcaccatgttttcctgtagttgtcatttataactagctcgggacaagcagagcttgagggacaggagggtagagctcagaaactttctgtctcatggttaaggccagaaaagcagctgcaggtgtggtgcatgcctcccatagacacttgaagctgggaatcctcaggtctccttccccaaaggaggtgaggcaagggtaagagctggagaggggcccttaagatccaggggttctctgcggtgcaacccatagcctgctcctctgggacagttgacagggagggctctggagtgcctggctgagcctctggccctgctccatgctgctggcctcacacacaggctcccttgcttctgttccttcttggcctcttcccaagtgtccccatggcattcctcagggtatggagcatcggcaggaagggtcatgagcccagagttgctttattaacaaagcagacacacagacacacacaacctcagaactgtagcaagtgctatgtttatactttgattctcattgggattgccctgcagacctttgtattttgttcaccgcacggggtcattataggcacttgggagccatgctgggccttattttaaagccagtctctctatttcctattaaagtcagtaggatttcaagagaaaatggaaaaagactgcaggatcatgattgtactctcttcaggagctggaaagagaatgaagcagtgagtttccagctctctgtaaggtgatggagagaagtggccttggagctgtggctcccagtgatggtcacagaactgcgtatgggccatccaagcccctatgccacgatgctcggggacacttcactgcctcatggtcacctaagtcaggttattcatgtgcttgggcttctctcaatggcatctgagaaaggaaaggagtgaagtctcttccaggcacagtggagctggccggggcatatgccctagagagaggtgtcaggaccccaaatactgacacgcaaggttagaagttcagctctgaaaagtcaacttggagggaatggaattaggagtacaggtgacagcatggacttatccagggagcttacctttgcctgtgttagacggtgaccccattcctggtacctctgccctaccaaagatattcagtgtttctgagagcctccggtctgagactgcccaccaccccaccccaccccacctccttagtcctgcccagtgctcacggcgagtcccagggctgggccctcggttgtctgtgcaaggcagggctgacctctcctggttcgcagggttggcacagatggccctgggaagacaaggcctgcgagctcaagggagagtcctgctccatgagccctaacctcatatgtagcttctcacatcaggcttacaggggctgcccctggcttctccaggttgcgacataattagatttagcctcagatggcggcatacaagtaagaggaagtctaatttcctaaggccgagtcacaactatctgtgactttgaataaagctgtgaggccttcagcctctttcacttgagaagctgccaaccagtccttgggtaagaggccgtaaaatatctggaatcccatctgttggctgccccctaacattctagtctgccatttcttaaacatgctcctcaacctgcttctgaagtttaggacccaccacttttaaggcagggcaggcctctaatcacccccaaaacccagcctcagaagaacctgccactggagacacttttttgcctctcagctctccagggacttgatgacaggcttcttgtctggcacccaacggtcaatgtcaagaggccctgccatttccctccagctctgcctgagggagacggatgtccgtgaaatttctcagacctctgggtatgaggggcaaagatggtataaggctttgaagtccagacatgttcttggggggaatgtagctttaggaatgcactcgtgaatcagcgcaaactgggctcatgactggaagccagctcctgcggcaggaatctgttcatcttgggtcacaggtgcacgtgtgggtgcatgggctttattctcctgtaatcctccctaggatttgagggattttttgctgtaattgttttctttgaaaaaacattgtgtaaatgagccaaacctttctcccttccttttcgcaccatgaacttgaccgcaggctgctttgtgctgactgccttcccatgccaggatgccactctgggttcccgagccaggaccatgtgcctcagataccagtgacctgagccttccagtataaaccattatctggtggctggagagagattagggaaacaaaaagttactaggtatgggacagaacatttagacttcagaaaaagtatgccaagagagaacagatttgcccaggatgtatgtttttcctctttgaggagtcggggcatgatatgtggcaccattatctagtaagtgctggttatttgatttctactaaattctttactttgaatgtcattcatattgaagctccatttcccagagaatatcctgacaggctgctttgaagagggtaggtcctgtccctgtcacttggctgctggttgaacgtgctcctcccggctgatggaggggtgggtttaaggttaactctaagaactaagatggtcaatgaggtggtgtttgttcttggtgggggggcattgactccagcaatgggcgctgccatcccatatacttacaaagggctcctccactggacatgacaagatagccaaaggacggaaacagagacgaccatttggttgagaaaccaaattgtctagtgtacaattaatgcaactcattgcattcatgaatgcaactcattgcattaatgcaatgctacattatgctaataaggttacaacattaatgctacaggatagcccaagtatttaaaaagctgagcccatttagcagccttccagcaaacttttggaaatgcatttcttacttgatttcttcttgttatccaatccctggggactgttttacccacaacctcttcgatccagtgtgctgctgttggccaaacatcagcccctttcctggaatcctcctctttcaaaagtggggagggctgggcaggggtaaaaatgtactataccaccccatcccattcagcaagcttcctctccaaatccttaaatggaaggtagaagtattatgccaactgtcaagctctttgtccaggcccttgtggggactaaatgaactctttaggaatactaggtataggaagactaggtataggaagattctcatttccccttgttgcactgaccactatgtctcccatgcatactctgggaaattttaggagccctggtggagatacacgttgctgatgtgcatttgattaataggttttactatgtcttgcaataaagacgtttagccttaagacccttgaatggaactccagctgtgatagagctgccaatgccccttcctctctcctcccttatcacctagtgttgcttaaagaggaggccattgagggcacacttgatgccccagacagcctccctctgttgctaaatcattgttattgctctatatactgccttctcactcgcttcaattaaaaattaccttcaccagctcctgtgccctccacctgggggagacttcatgatcctctcagcactgactgcaaacatcagagaaaaaaacattttctcaccaaaggtgttcatgttgagaagttttaatttctaccccctacagctcaaaagaatcaatgtgaatttatctgcagcttaaattcaagtgaaacttcattctcatgcaagcatatcagacttattctggaacctctagaactggacttgaattccctgcaggtgccagactggtgggtgccctccctgcctgccattaaacttttcttacagccactgtccctttatctgtgacttctgagtcatccgacggatccattagttgttcaatgagaagttcacagatcttgtatcaggatataaactgatcttatgttgaaggatgcaccctcccctaatgaatgtattctcttaatattccgatgctgtatttgtgcatcagttggagactgtccacatccgacatttcaccgacacctcaaggacacttctacttatgagcagttcatcattctggggcttctccttatattaatactctttccattgagtcctgccaaatcctttattgggttttctttttcctttgcatctgtcactttgtccaaatgagcatgaataaacaaaagtgtaaatgagctgatactatttttgtggtcagctgaggatgctgccaagaacaccactgtatatctgtggcttgggaatgttaagaggaacgtgcaggcccttccattgatgatattcccttctcaacatttttaaacaagcacaaatgatatttgtaaaaaaaaaaagttttatttattatggtaataaactattttatacatg

SEQ ID NO: 168188 - DNA, 3102 bp, Homo sapiens
  Payload ID: 13088
  Gene Symbol: KCNH1
  Gene Name: potassium channel, voltage gated eag related subfamily H, member 1
  Uniprot ID: O95259
  ENST ID: ENST00000367007
  CDS Start-End: 171-3059
gaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaacc

SEQ ID NO: 168189 - DNA, 4286 bp, Homo sapiens
  Payload ID: 13089
  Gene Symbol: KCNH2
  Gene Name: potassium channel, voltage gated eag related subfamily H, member 2
  Uniprot ID: Q12809
  ENST ID: ENST00000262186
  CDS Start-End: 403-3882
tccgcggccgggccgagccgcaggcgctgcccgagccgcgggcgctggagcggctgtcggcgcggtggcaggcgggagccaggagtccggggctcgggcgggcggagcgcagcgcggggacgcggcggagcgggccccgcggctcggcgggggccggcagacaggtgtgccggcggcgggcggctcgcgctcaggcggctccaggccgggcccggggtccggagcggggagccgggagccgagcgaggacccggcgcccgcagtccagtcttggccgcgcccgtgctcggcttggccgcggggtgcggggaccacggcccggccgggccacccgaagcctagtgctgggccgggccgggccggggtgggtgggggcccgcccggcccgcccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctggggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagataccaacatgatcccgggctcccccggcagtacggagttagagggtggcttcagtcggcaacgcaagcgcaagttgtccttccgcaggcgcacggacaaggacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggaga

SEQ ID NO: 168190 - DNA, 3267 bp, Homo sapiens
  Payload ID: 13089
  Gene Symbol: KCNH2
  Gene Name: potassium channel, voltage gated eag related subfamily H, member 2
  Uniprot ID: Q12809
  ENST ID: ENST00000330883
  CDS Start-End: 404-2863
ggggccgctggctgggcaccggcggggcgggggagcctagtgtggcggggtgggggtggggacctggtagaaggaggggccggctggaggagctgaggttccgagtgcggccgctgctgggctggcgggcgggcagagcacggcaccctggcagcagggcccacgccacggggccatgggcagctcgagccaggcaggctgctgcccacgcttactgccagggtgaccccagccctggggcccagccacaaccaccctggcttcatgccaggggctgctctggttgccagtcggccagcctcgggggtgcagcctgggctgggactgctgctggggtgcaggtgaggcagtggccgggccctcaggccccagggcaggcaggctgcagggagccaagtcctccatggcggccccagccgggaaggcgagcaggacaggggctctgcggcccagggcccagaaaggccgggtgaggcgggccgtgcgcatctccagcctcgtggcccaggaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctggggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagataccaacatgatcccgggctcccccggcagtacggagttagagggtggcttcagtcggcaacgcaagcgcaagttgtccttccgcaggcgcacggacaaggacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggaga

SEQ ID NO: 168191 - DNA, 2648 bp, Homo sapiens
  Payload ID: 13089
  Gene Symbol: KCNH2
  Gene Name: potassium channel, voltage gated eag related subfamily H, member 2
  ENST ID: ENST00000430723
  CDS Start-End: 330-2648
ggtccggagcggggagccgggagccgagcgaggacccggcgcccgcagtccagtcttggccgcgcccgtgctcggcttggccgcggggtgcggggaccacggcccggccgggccacccgaagcctagtgctgggcccgcccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctgggtatggggtggggggcgggcactggactggaaatgccctctgcagcctcaagaggtgcgagccttctgaatatgcagtcactggggctgtggacctgggactgcctgcagggtcactgggctcctttaattcacctaaactcaggccctccaagcggggccatggagaggagccccacgtggggtgaggctgctgaactctggggttcccacattctccttcccttcaggatccgccacaaacagacactttttgcttccttaaagtag

SEQ ID NO: 168192 - DNA, 3867 bp, Homo sapiens
  Payload ID: 13090
  Gene Symbol: KCNH3
  Gene Name: potassium channel, voltage gated eag related subfamily H, member 3
  Uniprot ID: Q9ULD8
  ENST ID: ENST00000257981
  CDS Start-End: 261-3512
ggccgcggggcctggagcccgggatttgtgggcggcgagggcgcgaggggccgcgcgccatgctccgggccccgacggcgcggacgccccctcgcgcgccagcgtccggcgcgaccccggatcccggtctgcgcattgccccccgacggctgcgctagggagcgcggggcccggcggggggcggccgagctgggcgccctcccccggcgcggagtccccgcaccccggagggatggggcgggcagccgcgggcgcctaagatgccggccatgcggggcctcctggcgccgcagaacaccttcctggacaccatcgctacgcgcttcgacggcacgcacagtaacttcgtgctgggcaacgcccaggtggcggggctcttccccgtggtctactgctctgatggcttctgtgacctcacgggcttctcccgggctgaggtcatgcagcggggctgtgcctgctccttcctttatgggccagacaccagtgagctcgtccgccaacagatccgcaaggccctggacgagcacaaggagttcaaggctgagctgatcctgtaccggaagagcgggctcccgttctggtgtctcctggatgtgatacccataaagaatgagaaaggggaggtggctctcttcctagtctctcacaaggacatcagcgaaaccaagaaccgagggggccccgacagatggaaggagacaggtggtggccggcgccgatatggccgggcacgatccaaaggcttcaatgccaaccggcggcggagccgggccgtgctctaccacctgtccgggcacctgcagaagcagcccaagggcaagcacaagctcaataagggggtgtttggggagaaaccaaacttgcctgagtacaaagtagccgccatccggaagtcgcccttcatcctgttgcactgtggggcactgagagccacctgggatggcttcatcctgctcgccacactctatgtggctgtcactgtgccctacagcgtgtgtgtgagcacagcacgggagcccagtgccgcccgcggcccgcccagcgtctgtgacctggccgtggaggtcctcttcatccttgacattgtgctgaatttccgtaccacattcgtgtccaagtcgggccaggtggtgtttgccccaaagtccatttgcctccactacgtcaccacctggttcctgctggatgtcatcgcagcgctgccctttgacctgctacatgccttcaaggtcaacgtgtacttcggggcccatctgctgaagacggtgcgcctgctgcgcctgctgcgcctgcttccgcggctggaccggtactcgcagtacagcgccgtggtgctgacactgctcatggccgtgttcgccctgctcgcgcactgggtcgcctgcgtctggttttacattggccagcgggagatcgagagcagcgaatccgagctgcctgagattggctggctgcaggagctggcccgccgactggagactccctactacctggtgggccggaggccagctggagggaacagctccggccagagtgacaactgcagcagcagcagcgaggccaacgggacggggctggagctgctgggcggcccgtcgctgcgcagcgcctacatcacctccctctacttcgcactcagcagcctcaccagcgtgggcttcggcaacgtgtccgccaacacggacaccgagaagatcttctccatctgcaccatgctcatcggcgccctgatgcacgcggtggtgtttgggaacgtgacggccatcatccagcgcatgtacgcccgccgctttctgtaccacagccgcacgcgcgacctgcgcgactacatccgcatccaccgtatccccaagcccctcaagcagcgcatgctggagtacttccaggccacctgggcggtgaacaatggcatcgacaccaccgagctgctgcagagcctccctgacgagctgcgcgcagacatcgccatgcacctgcacaaggaggtcctgcagctgccactgtttgaggcggccagccgcggctgcctgcgggcactgtctctggccctgcggcccgccttctgcacgccgggcgagtacctcatccaccaaggcgatgccctgcaggccctctactttgtctgctctggctccatggaggtgctcaagggtggcaccgtgctcgccatcctagggaagggcgacctgatcggctgtgagctgccccggcgggagcaggtggtaaaggccaatgccgacgtgaaggggctgacgtactgcgtcctgcagtgtctgcagctggctggcctgcacgacagccttgcgctgtaccccgagtttgccccgcgcttcagtcgtggcctccgaggggagctcagctacaacctgggtgctgggggaggctctgcagaggtggacaccagctccctgagcggcgacaatacccttatgtccacgctggaggagaaggagacagatggggagcagggccccacggtctccccagccccagctgatgagccctccagccccctgctgtcccctggctgcacctcctcatcctcagctgccaagctgctatccccacgtcgaacagcaccccggcctcgtctaggtggcagagggaggccaggcagggcaggggctttgaaggctgaggctggcccctctgctcccccacgggccctagaggggctacggctgccccccatgccatggaatgtgcccccagatctgagccccagggtagtagatggcattgaagacggctgtggctcggaccagcccaagttctctttccgcgtgggccagtctggcccggaatgtagcagcagcccctcccctggaccagagagcggcctgctcactgttccccatgggcccagcgaggcaaggaacacagacacactggacaagcttcggcaggcggtgacagagctgtcagagcaggtgctgcagatgcgggaaggactgcagtcacttcgccaggctgtgcagcttgtcctggcgccccacagggagggtccgtgccctcgggcatcgggagaggggccgtgcccagccagcacctccgggcttctgcagcctctgtgtgtggacactggggcatcctcctactgcctgcagcccccagctggctctgtcttgagtgggacttggccccaccctcgtccggggcctcctcccctcatggcaccctggccctggggtcccccagcgtctcagagctccccctggcctcgagccacagctttctggacctccacctcagactcagagccccctgcctcaggagacctctgctctgagcccagcacccctgcctcccctcctccttctgaggaaggggctaggactgggcccgcagagcctgtgagccaggctgaggctaccagcactggagagcccccaccagggtcagggggcctggccttgccctgggacccccacagcctggagatggtgcttattggctgccatggctctggcacagtccagtggacccaggaagaaggcacaggggtctgagtaccagccctagaactcagcgttgccaggtgtgctgccatctgctgttcggcccaacctcagagtgaaggcagggtggcagcctccccacggactccatgcggcccgctggctcagggcagggagcctggaagcaaaggaggacctggctcctgactctcagagaggataggctggatccctggggcaggcctctcctcggcctgctcctctgacctcccggtctccctctgcaggctgggggcagaggcctgaggacaaggaagagctttgccatcccctgcatgtgcccctgcctctacctgtccccaaatttttatattaaaaaaaaaaaataaaataaactactttggaa

SEQ ID NO: 168193 - DNA, 3920 bp, Homo sapiens
  Payload ID: 13091
  Gene Symbol: KCNH4
  Gene Name: potassium channel, voltage gated eag related subfamily H, member 4
  Uniprot ID: Q9UQ05
  ENST ID: ENST00000264661
  CDS Start-End: 334-3387
gtgggccgctcccctctgggaggagggctgcccagaggggtgcgggtgtcgctagcggcccctccccgtgtggggccacgtggcgggtgcgggccgagcccgaggggaagaacctggcccgtggggaggtgggggggaccgaaacggcgctgagccgagccgagagctacggggttcggagcagaggcagcggcagcggcagcggcagtaagagggaggggaggaggcaggagggcgcatggggcgccccggcccctccgacagcgcgccccctccggcccggccgcgctgaaagctccccagcgccgcgccttgaacccacgccccggggccatgccggtcatgaaggggttgctggccccgcaaaacaccttcctggacaccatcgccacccgttttgacggaacgcacagcaacttcctgctggccaacgcacagggcacacggggctttcccatcgtctactgctccgacggcttctgcgagctcacaggctacggtcgcaccgaggtcatgcagaagacctgcagctgccgtttcctctacggcccagagaccagtgagccagccctgcagcgtctgcacaaagccctggagggccaccaggagcaccgggctgaaatctgcttctaccgcaaggatggctcagccttttggtgcctcctggacatgatgcccatcaagaatgagatgggggaggtcgtgctgttcctcttttccttcaaggatatcactcagagtggaagcccaggacttggcccccaaggaggccgcggggacagtaatcacgaaaactcccttggtagaaggggagccacctggaaatttcggtctgccagaagacggagccgtactgtcctacaccgactgaccggccactttggccgccggggccagggaggcatgaaggccaataataacgtgtttgagccaaagccatcagtgcccgagtacaaggtggcctccgtgggggggtctcgctgcctcctcctccactacagcgtctccaaggccatctgggacggccttatcctccttgccaccttctacgttgcggtcaccgtcccctacaatgtctgtttctcgggtgacgatgacacccccatcacttcgcgacacacccttgtcagcgacatcgccgtggaaatgctcttcatcctagatatcatcctgaacttccgcaccacctatgtgtcccagtccggccaggtaatctctgctcctcgttccattggcctccactacctggccacctggttcttcatcgaccttattgctgctctgccctttgacctgctttacatcttcaacatcaccgtgacctcgctggtgcacctactgaagacagtgcggctgttgcggctgctgcggctgctgcagaagctggagcggtactctcagtgcagtgctgtggtgctcacgctgctcatgtcggtctttgcgctccttgcccactggatggcctgcatctggtatgtcatcgggcgccgggagatggaggccaatgacccgctgctctgggacattggctggttgcatgagttgggcaagcgtctggaggtgccctatgtcaatggctcggtgggcggcccatcacggcgcagcgcctacatcgcggcactgtacttcactctaagcagcctcaccagtgtgggctttggcaacgtgtgtgccaacaccgacgcggagaagatcttctccatctgcacgatgctcataggcgccctgatgcacgctgtggtgttcgggaacgtgacagccatcatccagcgcatgtactcgcgccgctcgctctaccacagccgcatgaaggacctcaaggacttcatccgtgtgcaccgcctgccgcggccgctcaagcagcgcatgctcgaatacttccagaccacgtgggccgtcaacagcggcatcgacgccaacgagttactgcgtgacttcccagacgagctgagagctgacattgctatgcacctgaatcgggagatcctgcagctgccgttgttcggggcagcgagcaggggctgcctgcgggccctatcgctgcacatcaagacctcgttctgcgctccgggcgagtacctgttgcgccgtggggatgccctgcaggcacattactatgtctgctccggctcgcttgaggtgctccgagacaacatggtgctggccatcctggggaagggggacctgattggagcagatatccctgagccggggcaggagcctgggttgggagcagacccaaacttcgtgctaaagaccagtgctgatgtgaaagctctgacctactgtggcctgcagcagctgagcagccgagggctggctgaggtcctgaggctctatcctgagtatggggctgccttccgggctggcctgccccgggacctcaccttcaacctgcgccagggctctgacaccagtggcctcagccgcttttcccgatcccctcgcctctcccagccccgctcagaaagcctcggctcctcctcagacaagacgctgccatccatcacagaggccgagagtggcgcggagcctgggggtggtcccaggccccgacggcccctcctgctgcccaacctcagcccagcacggcctcggggctccctggtcagccttttgggcgaggagctgcccccattctcagcccttgtctcctctccttccttatccccatccctgtcccctgccctggctggccagggccacagtgcctcccctcacggcccccccaggtgctctgctgcctggaagccccctcagcttctcattcccccactgggaacctttggacctccggacctcagtccccggatagtggatggcattgaggactctggcagcacagctgaggccccttcattccgattcagcaggaggcctgaactgccaaggccccgctcccaggcgccccctacagggaccaggcccagcccagaattggccagtgaggctgaggaggtgaaggaaaaggtttgccggctgaaccaggagatctctcgtctcaatcaggaggtgtctcagcttagccgggagctgcggcacatcatgggcctgctgcaggccaggctgggtcccccaggccacccagcaggctccgcttggaccccagaccctccttgtccacagctgaggccaccatgcctctctccttgtgcgtccagaccaccacccagcctccaggatactacgcttgctgaagttcactgcccagccagtgtggggaccatggagacagggactgcgctcctggacttgagaccttccatattgcccccctacccctcagagcctgaccctctgggaccctctccagtgccagaggcctcacccccaaccccaagcctcttgaggcacagtttccagtccaggtcagacacgttccactgaccctggcccagggcccaggcctgtctggggtgggcgctgccgctcaccactcagggaggacctgggccccttggcttcctgccttggggtcagcagccaccagctggcctggttggctctggatttctggactttttaatgaagcgtggttacctctgacgctattcccttttccaagccttccccaacctccccctctgtgaggggagccacctgagggctgtggaacccagcaggcatgagatgaaccgcagtgcccattgggctgggcagatgagatcctactttctccccaggacctggaggcaggctgtctctcaaggtggtctcttctgctgctagcaactcaaaaatcccaacagcactccctatcctttccctgaccccagaccgctgccaagcctgttctcccccattacaacatggtctcactcagggcctggactgctccaaaactcgcccaggtctccagctctcctctaccacccaacaccctgggctcacttttggataggaaataaactctttatttt

SEQ ID NO: 168194 - DNA, 3723 bp, Homo sapiens
  Payload ID: 13091
  Gene Symbol: KCNH4
  Gene Name: potassium channel, voltage gated eag related subfamily H, member 4
  Uniprot ID: Q9UQ05
  ENST ID: ENST00000607371
  CDS Start-End: 137-3190
ggcagcggcagtaagagggaggggaggaggcaggagggcgcatggggcgccccggcccctccgacagcgcgccccctccggcccggccgcgctgaaagctccccagcgccgcgccttgaacccacgccccggggccatgccggtcatgaaggggttgctggccccgcaaaacaccttcctggacaccatcgccacccgttttgacggaacgcacagcaacttcctgctggccaacgcacagggcacacggggctttcccatcgtctactgctccgacggcttctgcgagctcacaggctacggtcgcaccgaggtcatgcagaagacctgcagctgccgtttcctctacggcccagagaccagtgagccagccctgcagcgtctgcacaaagccctggagggccaccaggagcaccgggctgaaatctgcttctaccgcaaggatggctcagccttttggtgcctcctggacatgatgcccatcaagaatgagatgggggaggtcgtgctgttcctcttttccttcaaggatatcactcagagtggaagcccaggacttggcccccaaggaggccgcggggacagtaatcacgaaaactcccttggtagaaggggagccacctggaaatttcggtctgccagaagacggagccgtactgtcctacaccgactgaccggccactttggccgccggggccagggaggcatgaaggccaataataacgtgtttgagccaaagccatcagtgcccgagtacaaggtggcctccgtgggggggtctcgctgcctcctcctccactacagcgtctccaaggccatctgggacggccttatcctccttgccaccttctacgttgcggtcaccgtcccctacaatgtctgtttctcgggtgacgatgacacccccatcacttcgcgacacacccttgtcagcgacatcgccgtggaaatgctcttcatcctagatatcatcctgaacttccgcaccacctatgtgtcccagtccggccaggtaatctctgctcctcgttccattggcctccactacctggccacctggttcttcatcgaccttattgctgctctgccctttgacctgctttacatcttcaacatcaccgtgacctcgctggtgcacctactgaagacagtgcggctgttgcggctgctgcggctgctgcagaagctggagcggtactctcagtgcagtgctgtggtgctcacgctgctcatgtcggtctttgcgctccttgcccactggatggcctgcatctggtatgtcatcgggcgccgggagatggaggccaatgacccgctgctctgggacattggctggttgcatgagttgggcaagcgtctggaggtgccctatgtcaatggctcggtgggcggcccatcacggcgcagcgcctacatcgcggcactgtacttcactctaagcagcctcaccagtgtgggctttggcaacgtgtgtgccaacaccgacgcggagaagatcttctccatctgcacgatgctcataggcgccctgatgcacgctgtggtgttcgggaacgtgacagccatcatccagcgcatgtactcgcgccgctcgctctaccacagccgcatgaaggacctcaaggacttcatccgtgtgcaccgcctgccgcggccgctcaagcagcgcatgctcgaatacttccagaccacgtgggccgtcaacagcggcatcgacgccaacgagttactgcgtgacttcccagacgagctgagagctgacattgctatgcacctgaatcgggagatcctgcagctgccgttgttcggggcagcgagcaggggctgcctgcgggccctatcgctgcacatcaagacctcgttctgcgctccgggcgagtacctgttgcgccgtggggatgccctgcaggcacattactatgtctgctccggctcgcttgaggtgctccgagacaacatggtgctggccatcctggggaagggggacctgattggagcagatatccctgagccggggcaggagcctgggttgggagcagacccaaacttcgtgctaaagaccagtgctgatgtgaaagctctgacctactgtggcctgcagcagctgagcagccgagggctggctgaggtcctgaggctctatcctgagtatggggctgccttccgggctggcctgccccgggacctcaccttcaacctgcgccagggctctgacaccagtggcctcagccgcttttcccgatcccctcgcctctcccagccccgctcagaaagcctcggctcctcctcagacaagacgctgccatccatcacagaggccgagagtggcgcggagcctgggggtggtcccaggccccgacggcccctcctgctgcccaacctcagcccagcacggcctcggggctccctggtcagccttttgggcgaggagctgcccccattctcagcccttgtctcctctccttccttatccccatccctgtcccctgccctggctggccagggccacagtgcctcccctcacggcccccccaggtgctctgctgcctggaagccccctcagcttctcattcccccactgggaacctttggacctccggacctcagtccccggatagtggatggcattgaggactctggcagcacagctgaggccccttcattccgattcagcaggaggcctgaactgccaaggccccgctcccaggcgccccctacagggaccaggcccagcccagaattggccagtgaggctgaggaggtgaaggaaaaggtttgccggctgaaccaggagatctctcgtctcaatcaggaggtgtctcagcttagccgggagctgcggcacatcatgggcctgctgcaggccaggctgggtcccccaggccacccagcaggctccgcttggaccccagaccctccttgtccacagctgaggccaccatgcctctctccttgtgcgtccagaccaccacccagcctccaggatactacgcttgctgaagttcactgcccagccagtgtggggaccatggagacagggactgcgctcctggacttgagaccttccatattgcccccctacccctcagagcctgaccctctgggaccctctccagtgccagaggcctcacccccaaccccaagcctcttgaggcacagtttccagtccaggtcagacacgttccactgaccctggcccagggcccaggcctgtctggggtgggcgctgccgctcaccactcagggaggacctgggccccttggcttcctgccttggggtcagcagccaccagctggcctggttggctctggatttctggactttttaatgaagcgtggttacctctgacgctattcccttttccaagccttccccaacctccccctctgtgaggggagccacctgagggctgtggaacccagcaggcatgagatgaaccgcagtgcccattgggctgggcagatgagatcctactttctccccaggacctggaggctgtctctcaaggtggtctcttctgctgctagcaactcaaaaatcccaacagcactccctatcctttccctgaccccagaccgctgccaagcctgttctcccccattacaacatggtctcactcagggcctggactgctccaaaactcgcccaggtctccagctctcctctaccacccaacaccctgggctcacttttggataggaaataaactctttatttttgta

SEQ ID NO: 168195 - DNA, 11290 bp, Homo sapiens
  Payload ID: 13092
  Gene Symbol: KCNH5
  Gene Name: potassium channel, voltage gated eag related subfamily H, member 5
  Uniprot ID: Q8NCM2
  ENST ID: ENST00000322893
  CDS Start-End: 270-3236
gttcccgagccccgtgtgcggcaccgccacagtctgggcagcggcggccgggggagcgctactaccatgaactgcctggtcctcctccccagagctgctcatccgggtcgggctggagacacagtcaggggaccccgtcgccgccgccgcgccccctcttctttcggctcaatcttctcttccaccttttcctcctcttcctccaccttctttgcctgcatccccccctcccccgccgcggatcctggccgctgctctccagacccaggatgccggggggcaagagagggctggtggcaccgcagaacacatttttggagaacatcgtcaggcgctccagtgaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagggaagggtgatgtatttggagacatcttctggaaggaaaccacccttgcccatgcatgtgcgaacgtccgggcactgacgtactgtgacctacacatcatcaagcgggaagccttgctcaaagtcctggacttttatacagcttttgcaaactccttctcaaggaatctcactcttacttgcaatctgaggaaacggatcatctttcgtaagatcagtgatgtgaagaaagaggaggaggagcgcctccggcagaagaatgaggtgaccctcagcattcccgtggaccacccagtcagaaagctcttccagaagttcaagcagcagaaggagctgcggaatcagggctcaacacagggtgaccctgagaggaaccaactccaggtagagagccgctccttacagaatggagcctccatcaccggaaccagcgtggtgactgtgtcacagattactcccattcagacgtctctggcctatgtgaaaaccagtgaatcccttaagcagaacaaccgtgatgccatggaactcaagcccaacggcggtgctgaccaaaaatgtctcaaagtcaacagcccaataagaatgaagaatggaaatggaaaagggtggctgcgactcaagaataatatgggagcccatgaggagaaaaaggaagactggaataatgtcactaaagctgagtcaatggggctattgtctgaggaccccaagagcagtgattcagagaacagtgtgaccaaaaacccactaagaaaaacagattcttgtgacagtggaattacaaaaagtgaccttcgtttggataaggctggggaggcccgaagtccgctagagcacagtcccatccaggctgatgccaagcaccccttttatcccatccccgagcaggccttacagaccacactgcaggaagtcaaacacgaactcaaagaggacatccagctgctcagctgcagaatgactgccctagaaaagcaggtggcagaaattttaaaaatactgtcggaaaaaagcgtaccccaggcctcatctcccaaatcccaaatgccactccaagtacccccccagataccatgtcaggatatttttagtgtctcaaggcctgaatcacctgaatctgacaaagatgaaatccacttttaatatatatacatatatatttgttaatatattaaaacagtatatacatatgtgtgtatatacagtatatacatatatatattttcacttgctttcaagatgatgaccacacatggattttgatatgtaaatattgcatgtccagctggattctggcctgccaaagaagatgatgattaaaaacatagatattgcttgtatattatgcagttgactgcatgcacactttacatttatttataatctctattctataataaaagagtatgatttttgttacccaaggcaatgtaatatttgaagaatcagggtccaacctgccaatgttgccatgacaaatttgatctcaggctgagtatgtatatcgagctatcattttctcactgttctgttaagttaaaagtatagattaatgccaaggaagagttcagtcttttaaactattagtaccatgttatgatctctttccataggatatttttctgtaacttagtgttaggttcttttcccctacaggcagtgtttgctccatttaaatgactgtttagttgcctaagtcagataagagtgtgggatattgaaaacttattgctatgggttttgtgcatgaattacatttttgatcaactatacctctcgttttttaacattatacttagatagtaatcattagctcttatgtaaggaaatccctactccctccttcttggagaacagctgccatcttgtaagctgacattatcaacatcataaatactaaactattaatatagagtatgttattatagaaacactgcaccacagggtataagggccttttgacaattcatgtaagagatgctgaatttccaaagctgataaatgctctaaatttgtatttccaaaacatgttcaagagtgacattgaaaggcttgttagcaaagaaacatacaaaaaataaagcatttaagtaatcatatcaaaatgctaactattatggtataaaataaaaaagaatgtaaacagatagataaatttttgtggcatgtatataacttagaaagaatgaaacactggtacggattgttgacacatgaatcctagtgtttgtagtgataacacatgaaatgtggtaaaacaaacaaaccaaccaaccaagaagtagacattaagttgctcgactcagataactgcttttctatcattttattgtggttatagttttttaaagctttttgcacacagttctactgctggacttctgctgagttgattcaataagctattgtggctcaggcaggtccatttgtgaaagggggatactaaagactgaattttagtcttttgaattcaaatcctctttgtagaaagtgcctattatcaagtttttaaaaaaagtcacaaagagttgtcctgtatatagctagtcccttaaatgataaggattgagaataaaatacacattcacttgtaagaacccaggagaacttatttcttttgactaaactgtattttaggaagtcgttcagggaagcatacttttcagtcagtgcatgcacagcatttaatatggggagcaggggagttagtgtttgcatgaagttgaaaaaaatgtgtgagtaatttatatattacgggaccatctgtacatatatgttaacaatatgcaaaagatgatggcaaaatcgaaggagatatcttgatctattatacccatttgtatgagcttttctatctcccagtattcccaaccaaagccactagaactgaaagacatgttatcacattcagacttgagaagtgcaaaacagtgatttataaaaacagttgctattttagaatttctattgaacttcacatgcccacaagatgtgcctctttaatctaggagtctcaaaacatatgagccatgggctccattttcctttctttatgcgtataacttccattaaccataatggaagttttcaggggaacacgtctccatgtaatgctacaatatctacctaccacaaacacaagaaaatgaaataattatggagtaaagaatcagccttgaaattggaattttgttgctttcatggtgaggatgatatctttttcgtgacctctgacatttattgaatttcagggtatttttctatttgtttaagtcaagtttggcttaagcttttaaaggtgaatgtgtggttaaaataagaatctgattatagaagttgttagtttaactttagccagtgcttcaaaactaactattggtgtaaagctataaaagaatgactgtgaacaacatgatgatttgaagttctaattcatggctttgcatattagtggtgcaaatatttactgtgttctgacattgacgtagagtttcacctaatcgacctacaatgttattgttcatatatgtgagaaacataatggttttgaattactccagattgttaggaaggagggaaagtatcaattgtttaattatggtgcagttatcatagtgtcttttcagccatctctgttctctgtgtgcatgatatgaagaggtgctgaatgcaccctgctgttttcagcaggaatgcatgttttcagcaaacattgtatatagagtagtcttttaggttcccagattccacaaatcttagcagttgaatttactcagatttgaatgaagggagaatatttgctttaatacatgcaataatgataaaatcatgttctatgttgcctcaactagcacatagacagtagatgctcttttgaggaccagataactgcatgttttattcctacactgtatagatgctcttggtgcatccagaataaaaattttaatattatatttctaaataatatattaataggagtaaatggatatgtattagaaatccaaacattttccaaagcaatttacacaccttcaatatttttctatgatgttattaataggtaagatcagatgctgtatcctcgacaggtggttgtaacaaaatagcaaaagtcaaattagaatggaaatgtgagtgatgtatcataatggcaggttttatcagtctgtatcaggatattgttgcactaaatgtgatctagcagatggaagagattatgataaaaagcaaataggcacacaaaagccagatgacaataccaaagctatatgaatggtactgaaaatggttcaggcacagtggttgaattgaatgacgtggttgaatacaggcccatgcttcattgttaaaatggaaaatttttatgacactagttgcatcttgcattaagtataggactaaaaatgtcctaagtattttttacaaacaactttatgtatatcagagaaaaaaatggaaaatctggggtttgaaattgctctagaaaaaatgtgtacttctgttgtactcaacactttaataggaaaattagttgtgaccgctaactaaagtaccattatcaaaattaaccttattggagcccaaatgaaaatcacattttcccttctgtttaaggagattttgttcaccctgtgatatctggtccatttgatatcttattttaaatagctaaagtcatttggaattttttttaatattagccttcagagcagtgactgttttgaagtgtgcagtggcagatatttgtgaaattattcatcatatttctaatgaattccactatcttgtataatttttatcttttaagcaattttctatgagtttgttttccaaaattccatgtaggtaatgagaacatttatctagaatgtgcatatcatacatggataactttcaaatatgaatattttataatcatgtgaatgttgtgctataattttttctattaggtgtaaaagtatttctcttctcatcttaatggaaagggggaaaagacaaaaacagtcttttggaaaacaccttaagtcttagtatctgagctttgtcttgtgttctgaatttagctttaccacaaactagaagtgtaattatgggcaagttaacctttcctagtgtaccaaatggtaccatttccccgccaataaataagaaaacaaagataacagctgttgcttccttatatcaacatgctattggtcaatgaaaaaattatctttcttgcaggtgaaaatcacattatgacaagtgatcactttttcattctttcatagaagagtatccacgatgtactctctatcaaaatattcttctagattttagaagagatttcagggattgacggtgatgtgatttttatctaaatattcttttaggttttagaagagatttatctggtcagaggttaatggagagaggcatagtttgctagtggcaggtaagcataaaacttcatacttatgtgggaatttagaactacaaatcaaataaacgtggaaagaatgaagctcctttgacagaagagagagagaagagaaagataggtaaattttgtgatttttcttatttctacttaatcatactgcttggcagaaattctcaattttgtgaaaaaattggtaagtggccaaggtatagagtagttcaccaatgtatctatgtaacaaaactgaatgtgtaccccttaaatttatacaaataaaaactagagtagttcatccttcaactttttatattaaaataatcatgacctgttcaagatatatgattccacatgggcagacactcttataacaaaattcttaactatgtgctatgtgttgtaagttttggcctatattctgacttgagattttctatcacttcatttgtaggataagacccctgtgtttgcattctttatgagggtcaggaccactgaggatttggactgggaactagaaagatgatgaaggcaagggttgagaaaagactgattagaatctatctgcttctttactcttaggcttagaagttaaataagttaactaagcttatatttaccaaggtctcactatgataagcattttatttaggttatcaaatttaattcttgcagcaaccccatgaaggtataggttaaggaacttgtccaggatggcatacttgttacatggtaaagttgagtttctaacacaggcagtcagaccttagggagaaacctttattttgtagaatactgacattacaagaactatctagttcaaccatctagtctaggtttttccagacacatacttttaaagatttcttaaaataattcttaaaaattgcactcgataatgtgaatgtaaatgtttggtttttcttgataggtcagagtcaatgacagagtttgaaatcatactgtcttaagcaaaaggtgccctgtcccaacagtggaattttcctttacttctcctaacagttgaaagacatcggccaaagtaaactgtcaaatgtggtatgtttgatatatggtcactggtatcaacattttcttttccagttgaattttaacctaaagaggtaatgcctaatggttaaggaaagcaagagtcattcaggattttttttctataatttctttttctttttaatagtgggatttggatgagactccagaatttatttttaaaatttattttttgactcattgggttttaagtagattattcagatatttttattgattgcactgatgttggcttcttggccaaaccactattaaatacattatccaaatgaactatttctgtttagaatggcaacttgtatccttatttccaaaattaatgagctcacagtatgtatatttacttcagagagtttcaataattttctctaatgaaaaaatgttaattttctgaatgtgatttatttgttctaccctttgagatttctaaagcaagtgtcttgagataaggagaaaaaaacaagatattacaacactacatgctggaatcttcagcccaaaccatcttgttttcacttggctaataactgagccagaggtaatcatagaaaggaagaatcctacttttaaaataatgactgtgaaggaccccactgacaccatccaaagctttttatagtcagctcacttccatcctggcttttacattaccactgcatgattatttaaatgaggtcatgtcttgtactacttgtaaaggcacttggtcaaagaagagtaaaccaaaaagtgcagcttatgaccagagttataactgaggaaaaaggagtgtggagaagggacagcagttgcttccttttaatgagttttctgtatgtggtgccttttaaatagcttttgtttatttgtttttaagatgacacattgtcattaaggttttaacaaaaacctttggaagcagtttgaaagcttgtcaaatgctggggccttctttagaaataagtgttctcccaccaaccaatgagtttagaacctctggttctgacctacaaacccaatcccctaagcacttggctggttgggctgcattttgatgggaggaaacaaaaagatctgatcactctctctcattcatgcggaatcactgactgttgaatgaccaaagcagtcaaagccaaaatattcaccttgaagcttcaataaaccagattgagtatccataataactaatttaagtaattttatccccattctctgctaaatcatatttcataatataaaatgtaaccacttccctctatccaaagcttttggtcagactctccattgagttagagaaattggactttggcaaaaagcaacataaagattattgttgttcctagaaccattgttgccatggacccctcatttgctcctcaactttttcaaccaaattatagcgggaaagattcctgatgaagccaagactgcaaacaggaagaatacctagctagtaaactatgcaaaatcacaacaaagattcatttataattccatgttacagtgtttgatagtcctaagtatttaatattggtatattatgtcacagccatgaactgtcaacttacacaaaatccaaacgcactttcatttaaaatcaagattagcctatttcattttcaggaaaaaacagttgtcagaattgcttttttgacctctgcagggatgttttcacattgctattcttatgaccctttatcagagagggaataagtgtagtgttcactttcatctccttagggttgactgcaccagcatcttccatcaagcagtcgccttccaccttagaacctgttcacagttaataaagcaagggggaatatgcatttcatattaggaacagatttcttaagtgattgttatgaaaagtggaaaccagtttagaaccatttttttaccctaaaacatccattgtagtttgttgaaagagcaatgacttttagaagtgcttggtactcaaacaacacaaaatgtgcagattcacgatatattgaaaattatagagttctttttagtctatgttctagtgactttgtttacactagttgtggcattttgtatactacaatgtaaattctactataacactaatgttactatgggaattaattttgcaacttcttaaatgtttttgtcactgcaaccatattggtgagatattgggggtattaaaaatgcctctgcctttaagggttaattcaccagaaataattgattcatgcattgacaaaggaaacaatgcaaaaatttcatgtgggatgtttttaataccattatgctaagcagtacttgttggcttttttcaaaatctgattcatgctaagcagatccttttttctacttaaacaaagatactgcaatgtataatatagaaattttgtatgtactgttgacctatcacctgactgctgacaggatgtgtgaaaatattttaactttgtgactttagggtcaattatgaaacaattgtgatcaaaattcagttgcttctgggaagtttgtggtgattatcactttatttaacgtttgttctcaaaaaatggtcattttgaaaagtgaattggcaggtggaagcttttagcccaaaagaaatctgggtttcagcacaataaactgtatttcatcagggaggactaactttgctttttttcacactttatttaaatgtggatattttttcatgatacagaataaaatgtgcattttatggaattaatttgaa

SEQ ID NO: 168196 - DNA, 2490 bp, Homo sapiens
  Payload ID: 13092
  Gene Symbol: KCNH5
  Gene Name: potassium channel, voltage gated eag related subfamily H, member 5
  Uniprot ID: Q8NCM2
  ENST ID: ENST00000394968
  CDS Start-End: 169-2043
tgagcaaatgaaagacaccaacaaaatccaacacataaagattcacacttgaaacagattaatcaggaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagggaagggtgatgtatttggagacatcttctggaaggaaaccacccttgcccatgcatgtgcgaacgtccgggcactgacgtactgtgacctacacatcatcaagcgggaagccttgctcaaagtcctggacttttatacagcttttgcaaactccttctcaaggaatctcactcttacttgcaatctgaggaaacggggatggttctccatggcaaacgctctgtgaagggtgacctgctgggtgtgaaactgctgcacgacttcctacttcacccattcatctatccgagttttcacggagtccaggagaaagtataaaagttaccttgaggagcaggagagtggaatggttaagactgtttggaatctgaccccttggatttgcatcctggacacacagttgtgtgacctaagggaaaccacttaaactctttatgcctcaatttgcttctctgtgataaaagaataatatgacctgtgtcctacagtagagaataataggtcctagctcgtaaaatgttctcattccatgacacttaaatgagaaaatacgtgtgtggaagtgaccactttgctatatacagatattttattatcattttacaatgccattattttgttccatagtcaaaagtaaaataaaacaaatgtcaatttgtcttattctaatcct

SEQ ID NO: 168197 - DNA, 2711 bp, Homo sapiens
  Payload ID: 13092
  Gene Symbol: KCNH5
  Gene Name: potassium channel, voltage gated eag related subfamily H, member 5
  Uniprot ID: Q8NCM2
  ENST ID: ENST00000420622
  CDS Start-End: 1-1836
atgccggggggcaagagagggctggtggcaccgcagaacacatttttggagaacatcgtcaggcgctccagtgaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagatcatctttcgtaagatcagtgatgtgaagaaagaggaggaggagcgcctccggcagaagaatgaggtgaccctcagcattcccgtggaccacccagtcagaaagctcttccagaagttcaagcagcagaaggagctgcggaatcagggctcaacacagggtgaccctgagaggaaccaactccaggtagagagccgctccttacagaatggagcctccatcaccggaaccagcgtggtgactgtgtcacagattactcccattcagacgtctctggcctatgtgaaaaccagtgaatcccttaagcagaacaaccgtgatgccatggaactcaagcccaacggcggtgctgaccaaaaatgtctcaaagtcaacagcccaataagaatgaagaatggaaatggaaaagggtggctgcgactcaagaataatatgggagcccatgaggagaaaaaggaagactggaataatgtcactaaagctgagtcaatggggctattgtctgaggaccccaagagcagtgattcagagaacagtgtgaccaaaaacccactaagaaaaacagattcttgtgacagtggaattacaaaaagtgaccttcgtttggataaggctggggaggcccgaagtccgctagagcacagtcccatccaggctgatgccaagcaccccttttatcccatccccgagcaggccttacagaccacactgcaggaagtcaaacacgaactcaaagaggacatccagctgctcagctgcagaatgactgccctagaaaagcaggtggcagaaattttaaaaatactgtcggaaaaaagcgtaccccaggcctcatctcccaaatcccaaatgccactccaagtacccccccagataccatgtcaggata

SEQ ID NO: 168198 - DNA, 3062 bp, Homo sapiens
  Payload ID: 13093
  Gene Symbol: KCNH6
  Gene Name: potassium channel, voltage gated eag related subfamily H, member 6
  ENST ID: ENST00000314672
  CDS Start-End: 54-2930
gacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcaga

SEQ ID NO: 168199 - DNA, 2928 bp, Homo sapiens
  Payload ID: 13093
  Gene Symbol: KCNH6
  Gene Name: potassium channel, voltage gated eag related subfamily H, member 6
  Uniprot ID: Q9H252
  ENST ID: ENST00000456941
  CDS Start-End: 81-2798
acgctgctgagcccgaggacagacggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctgcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatca

SEQ ID NO: 168200 - DNA, 2973 bp, Homo sapiens
  Payload ID: 13093
  Gene Symbol: KCNH6
  Gene Name: potassium channel, voltage gated eag related subfamily H, member 6
  ENST ID: ENST00000583465
  CDS Start-End: 56-253
gagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggagcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaatt

SEQ ID NO: 168201 - DNA, 3821 bp, Homo sapiens
  Payload ID: 13093
  Gene Symbol: KCNH6
  Gene Name: potassium channel, voltage gated eag related subfamily H, member 6
  Uniprot ID: Q9H252
  ENST ID: ENST00000583023
  CDS Start-End: 12-2996
gcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagggtctccccatgagctggggccccagttcccctctaagggctacagcctcctgggtcctgggagccagaactccatgggggcaggaccttgtgctccagggcacccagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaattaaaaaagaaaaaaaatagccgggcgtggtggcaggcgcctgtaatcccagctactggggaggctgaggcaggagaatggcatgaacccgggaggtggaggttgcagggagccgaggccgcaccactgcactccagcctgggtgacagagtgagactccaactcaaaaaaaaaaaaaaaaaagatcttggggaggcagacagccccccagatgggcctctcctaaagtagctacaaactgctgatccaggtgacccaggatggcgtgggtgaagaagctcacgacttttcccagcctcctccagggctccatttaaacagcaagcctggtgcagggtgggagagtctcaggtgtggaggcagcttacaggattgagggggcagtgaagaaagaggtttctgatctacatgagtaccttgctctgagcctcccagctcagaaccctccagcacctcatggctcagcaccaaggcccggggttggtcagaactcttaccatgagcctctgacctggctggagatggaggtatgttctgtggcagacatgtcaggacagtcctccagccctctgctcctgatggttctgtgacattgggtctcttgagggcagtggagtgtcacacagctaataaagtacacatttcatgttgga

SEQ ID NO: 168202 - DNA, 3017 bp, Homo sapiens
  Payload ID: 13093
  Gene Symbol: KCNH6
  Gene Name: potassium channel, voltage gated eag related subfamily H, member 6
  Uniprot ID: Q9H252
  ENST ID: ENST00000581784
  CDS Start-End: 81-2798
acgctgctgagcccgaggacagacggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctgcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggggatttcctttagctgggcatggtggcgggcgcctgtaatcccagctactcaggaggctgaagcaagagaatcacttgaaccctaaaggcagaggttgcagtgagccgagatagtgccactgcactacagcccgggcgacagagtgagactccatctcaaaaataaaataaaatt

SEQ ID NO: 168203 - DNA, 1703 bp, Homo sapiens
  Payload ID: 13093
  Gene Symbol: KCNH6
  Gene Name: potassium channel, voltage gated eag related subfamily H, member 6
  Uniprot ID: Q9H252
  ENST ID: ENST00000580652
  CDS Start-End: 58-1566
cggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctgtgagtgagacctcatgccacggcctaacttcatgctctggtcttacccgtgaaattttatgtgtagttttgtactgagatagaacataacacatagcaacaattcatgcagtacactgatcctaagtgtgcagcacaatgaatt

SEQ ID NO: 168204 - DNA, 4113 bp, Homo sapiens
  Payload ID: 13094
  Gene Symbol: KCNH7
  Gene Name: potassium channel, voltage gated eag related subfamily H, member 7
  Uniprot ID: Q9NS40
  ENST ID: ENST00000332142
  CDS Start-End: 101-3691
caaagagcggctcgcgcgctggcctgggctctagccgaggagagatcccgggagaactccagagctccgggggagcgctcctcggaagaccggggccaacatgcctgtgcgcagggggcatgtggcaccacaaaatacatttctggggaccatcattcggaaatttgaagggcaaaataaaaaatttatcattgcaaatgccagagtgcagaactgtgccatcatttattgcaacgatgggttctgtgagatgactggtttctccaggccagatgtcatgcaaaagccatgcacctgcgactttctccatggacccgagaccaagaggcatgatattgcccaaattgcccaggcattgctggggtcagaagagaggaaagtggaggtcacctactatcacaaaaatgggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagacaatggtcgcaatgtcaaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtcctaaagggtttcccagaatgcttacaagcagacatttgtctacatctcaaccagacattgctgcaaaactgcaaagcctttcggggggcaagtaaaggttgccttagagctttggcaatgaagttcaaaaccacccatgcacctccaggagacaccctcgttcactgtggggatgtcctcactgcactttatttcttatccagaggctccattgaaattctcaaagatgacattgtggtggctattctgggaaaaaatgatatatttggagaaatggttcatctttatgccaaacctggaaagtctaatgcagatgtaagagccctcacatactgtgacttgcataagattcagcgagaagacttgttagaggttttggatatgtatcctgagttttctgatcactttctaacaaacctagagttgactttcaacctaaggcatgagagcgcaaaggctgatctcctacgatcacaatccatgaatgattcagaaggagacaactgtaaactaagaagaaggaaattgtcatttgaaagtgaaggagagaaagaaaacagtacaaatgatcctgaagactctgcagataccataagacattatcagagttccaagagacactttgaagagaaaaaaagcagatcctcatctttcatctcctccattgatgatgaacaaaagccgctcttctcaggaatagtagactcttctccaggaatagggaaagcatctgggctcgattttgaagaaacagtgcccacctcaggaagaatgcacatagataaaagaagtcactcttgcaaagatatcactgacatgcgaagctgggaacgagaaaatgcacatccccagcctgaagactccagtccatctgcacttcagcgagctgcctggggtatctctgaaaccgaaagcgacctcacctacggggaagtggaacaaagattagatctgctccaggagcaacttaacaggcttgaatcccaaatgaccactgacatccagaccatcttacagttgctgcagaaacaaaccactgtggtccccccagcctacagtatggtaacagcaggatcagaatatcagagacccatcatccagctgatgagaaccagtcaaccggaagcatccatcaaaactgaccgaagtttcagcccttcctcacaatgtcctgaatttctagaccttgaaaaatctaaacttaaatccaaagaatccctttcaagtggggtgcatctgaacacagcttcagaagacaacttgacttcacttttaaaacaagacagtgatctctctttagagcttcacctgcggcaaagaaaaacttacgttcatccaattaggcatccttctttgccagattcatccctaagcactgtaggaatcgtgggtcttcataggcatgtttctgatcctggtcttccagggaaataatcattttgtactatttactccacatacaatgtaagtgcttttaatggctgttttcctttttctatttaaatcctctctacttgactcaggggctcacaaggtaccattatatgcaaaagtactgtatattttcctaaattgaagcttgtaaggtaaaactgagcagttaggatgtaaatatacataagaacttttggttccaaatgttaaaactgccagcatctcacggcaccttattttttatttttattttttaaatcacatgcatgttaggaaactccaatttctcttgcatggagactcctatttactgcttttactaaaccagtacttcgttatgaaaatgccttccacgcaaataagaaaccaagggataaaactgttcatggatgcaactcaaattcagatgatcctcaactcat

SEQ ID NO: 168205 - DNA, 2434 bp, Homo sapiens
  Payload ID: 13094
  Gene Symbol: KCNH7
  Gene Name: potassium channel, voltage gated eag related subfamily H, member 7
  Uniprot ID: Q9NS40
  ENST ID: ENST00000328032
  CDS Start-End: 213-2411
ggccccctccggaaggtgaggggaatggattggactccggtggggaaagcgggtgtctagaagtggtgctaatgggaagagaattctggtttcaaaagaggatgctctgccacaaagagcggctcgcgcgctggcctgggctctagccgaggagagatcccgggagaactccagagctccgggggagcgctcctcggaagaccggggccaacatgcctgtgcgcagggggcatgtggcaccacaaaatacatttctggggaccatcattcggaaatttgaagggcaaaataaaaaatttatcattgcaaatgccagagtgcagaactgtgccatcatttattgcaacgatgggttctgtgagatgactggtttctccaggccagatgtcatgcaaaagccatgcacctgcgactttctccatggacccgagaccaagaggcatgatattgcccaaattgcccaggcattgctggggtcagaagagaggaaagtggaggtcacctactatcacaaaaatgggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtatgtatgtctgttttccaaaatgaaagtgccgcaggcattatagtgatagccaaaatggaataaaagccggaatcaccagctttgaa

SEQ ID NO: 168206 - DNA, 3713 bp, Homo sapiens
  Payload ID: 13094
  Gene Symbol: KCNH7
  Gene Name: potassium channel, voltage gated eag related subfamily H, member 7
  ENST ID: ENST00000618399
  CDS Start-End: 1-3291
aaaaataggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagacaatggtcgcaatgtcaaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtcctaaagggtttcccagaatgcttacaagcagacatttgtctacatctcaaccagacattgctgcaaaactgcaaagcctttcggggggcaagtaaaggttgccttagagctttggcaatgaagttcaaaaccacccatgcacctccaggagacaccctcgttcactgtggggatgtcctcactgcactttatttcttatccagaggctccattgaaattctcaaagatgacattgtggtggctattctgggaaaaaatgatatatttggagaaatggttcatctttatgccaaacctggaaagtctaatgcagatgtaagagccctcacatactgtgacttgcataagattcagcgagaagacttgttagaggttttggatatgtatcctgagttttctgatcactttctaacaaacctagagttgactttcaacctaaggcatgagagcgcaaaggctgatctcctacgatcacaatccatgaatgattcagaaggagacaactgtaaactaagaagaaggaaattgtcatttgaaagtgaaggagagaaagaaaacagtacaaatgatcctgaagactctgcagataccataagacattatcagagttccaagagacactttgaagagaaaaaaagcagatcctcatctttcatctcctccattgatgatgaacaaaagccgctcttctcaggaatagtagactcttctccaggaatagggaaagcatctgggctcgattttgaagaaacagtgcccacctcaggaagaatgcacatagataaaagaagtcactcttgcaaagatatcactgacatgcgaagctgggaacgagaaaatgcacatccccagcctgaagactccagtccatctgcacttcagcgagctgcctggggtatctctgaaaccgaaagcgacctcacctacggggaagtggaacaaagattagatctgctccaggagcaacttaacaggcttgaatcccaaatgaccactgacatccagaccatcttacagttgctgcagaaacaaaccactgtggtccccccagcctacagtatggtaacagcaggatcagaatatcagagacccatcatccagctgatgagaaccagtcaaccggaagcatccatcaaaactgaccgaagtttcagcccttcctcacaatgtcctgaatttctagaccttgaaaaatctaaacttaaatccaaagaatccctttcaagtggggtgcatctgaacacagcttcagaagacaacttgacttcacttttaaaacaagacagtgatctctctttagagcttcacctgcggcaaagaaaaacttacgttcatccaattaggcatccttctttgccagattcatccctaagcactgtaggaatcgtgggtcttcataggcatgtttctgatcctggtcttccagggaaataatcattttgtactatttactccacatacaatgtaagtgcttttaatggctgttttcctttttctatttaaatcctctctacttgactcaggggctcacaaggtaccattatatgcaaaagtactgtatattttcctaaattgaagcttgtaaggtaaaactgagcagttaggatgtaaatatacataagaacttttggttccaaatgttaaaactgccagcatctcacggcaccttattttttatttttattttttaaatcacatgcatgttaggaaactccaatttctcttgcatggagactcctatttactgcttttactaaaccagtacttcgttatgaaaatgccttccacgcaaataagaaaccaagggataaaactgttcatggatgcaactcaaattcagatgatcctcaactcat

SEQ ID NO: 168207 - DNA, 1893 bp, Homo sapiens
  Payload ID: 13094
  Gene Symbol: KCNH7
  Gene Name: potassium channel, voltage gated eag related subfamily H, member 7
  ENST ID: ENST00000621889
  CDS Start-End: 1-1893
gggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaaaagacgagaatgtggctattcttgtagccctttgaatgtggtagacttgattgtggatattatgtttatcatagatattttaataaacttcagaacaacatatgtaaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctcttaatgtgcatctttgccctgattgctcactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtatgtatgtctgttttccaaaatgaaagtgccgcaggcattatagtgatagccaaaatggaataa

SEQ ID NO: 168208 - DNA, 5137 bp, Homo sapiens
  Payload ID: 13095
  Gene Symbol: KCNH8
  Gene Name: potassium channel, voltage gated eag related subfamily H, member 8
  Uniprot ID: Q96L42
  ENST ID: ENST00000328405
  CDS Start-End: 267-3590
gggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccgggtcccccttccctgccgtcatcaggttccccttctcccttcttggcactttcctttcgaaccatccttctggacaaactttgatggagaatttcacaccacgctggaaaaatgccggttatgaaaggattactggcgccgcaaaacaccttcctggacaccatcgccacccgttttgacggaacacatagcaacttcatccttgccaatgcccaggtggctaagggtttccccatagtctactgttccgatggcttctgcgagcttgctggatttgcccgaactgaagtcatgcagaagagttgtagctgcaagttcttatttggggttgaaaccaatgagcaactgatgcttcaaatagaaaagtcactggaggagaaaacagaattcaaaggagaaattatgttctacaagaaaaacgggtctccattttggtgcctactggatattgttcccataaagaatgaaaaaggagatgtagtactttttctggcctcgttcaaagatataacagatacaaaagtgaagattactccagaagataaaaaagaagacaaagtcaaaggaagatcaagagcagggacccactttgactcagcccggagacggagtcgagcagtcctttatcacatctctgggcacctgcaaagaagagaaaagaacaaattgaaaataaataacaatgtttttgtagataaaccagcatttccggagtataaagtttctgatgcaaaaaagtccaaattcatacttctgcattttagcacttttaaagctggctgggactggcttattttgttggcaacgttttatgttgctgtgactgtaccttacaacgtttgctttattggcaatgacgacctgtccacaactcggagcacaaccgtcagtgacattgcagtggagattctttttattatagatattattttaaatttccgaacaacttatgtcagcaagtctggccaagttatctttgaagcaagatcaatttgcatccactatgtcacaacctggttcatcattgatttaatcgctgccctgccttttgatcttctgtatgctttcaacgtcacagtggtgtctctcgtgcatcttctaaagacagtgcgcctcttgcgtcttttgcgtctgctgcagaagttagaccgctattcccaacacagtactatcgtcctgactctgctcatgtccatgtttgcactccttgcacactggatggcgtgtatctggtacgtcattggaaaaatggagagggaagacaacagccttctgaagtgggaagttggttggcttcatgagttgggaaagagactggaatctccatactatggcaacaataccttggggggcccgtcgatccgaagtgcctatattgccgctctgtacttcacgctgagcagcctcaccagcgtgggttttgggaacgtctctgctaatacagatgcagaaaagatcttctccatctgcaccatgctgattggtgccttgatgcacgccttggtgtttggaaacgtgacagcaatcatacagaggatgtactccagatggtccctctatcacactagaactaaggatctgaaagatttcatccgtgtccatcacttgccccaacaactcaagcagaggatgctcgaatattttcaaacaacctggtcagtcaacaatggaatagattcaaatgagcttttgaaagactttccagatgaactgcgttctgacatcactatgcacttgaacaaggagatcttacagttgtccctttttgaatgtgccagccggggctgcctcaggtctctgtctctacacatcaaaacctctttctgtgctccgggggagtatctgctgcgtcaaggggatgctttgcaggccatctactttgtatgctcgggctccatggaagttcttaaagacagcatggtgctggctattcttgggaaaggggatttaattggagcaaatctatcaattaaggaccaagtgatcaagaccaatgcagatgtaaaggctttaacctactgtgatctccagtgtatcatcctcaaaggactctttgaagtgctagacctttacccagaatatgctcacaaattcgtggaagacattcagcatgacctcacatacaacctccgagaaggtcatgagagtgatgtgatatcaagactatcaaacaaatctatggtctcacagtcagagcccaagggaaatggcaacatcaacaagcgactcccatccattgtggaagatgaggaagaggaggaggagggggaggaagaggaggcagtctccctctctcccatctgcacaaggggatcttcttcgcgcaacaagaaggttggaagcaataaagcctacctgggcttaagcttaaagcaactggcctcgggaacggtgccctttcactcgcctatcagagtctccaggtcaaattcccccaaaaccaagcaggaaattgacccccccaaccataataaaaggaaagagaagaacttgaaattgcaactttcaactttgaataatgctggacccccagacctcagtccaaggattgttgatggaattgaagatggaaacagcagtgaagaaagtcagacttttgattttggctctgaacgaatcagatcagagcccagaatttctcctcctcttggagatccagagattggagctgctgttctcttcatcaaagcagaggagaccaagcagcagataaacaaactcaacagtgaggtaacaacattgactcaggaagtttctcagttgggtaaagacatgagaaatgtgatccagcttctggaaaacgttctgtcacctcagcagccatcacggttttgctctttgcacagcacctctgtgtgtccctccagggagagcttacagaccagaacgagctggagtgcacaccagccttgcctacacttgcaaacaggcggggctgcttatacccaagcacaactttgtagcagtaatatcacctcagacatttggagtgtggatccctcctctgtggggagcagcccccaacgaactggagctcatgagcaaaatcctgcagacagtgaactttatcattctccaagccttgattattcaccttcccactaccaggttgtccaagaaggtcatttgcaatttttaaggtgcatctctccacattcagattctacgttgacgcctctgcagtccatttcagcaactctctcatcttctgtctgctcctcttcggaaacatctttgcacctagttctcccaagcagatcagaggagggcagcttcagtcagggaactgtgagttccttcagtctggaaaacttaccaggatcttggaaccaggaaggaatggcatcagcttctacaaaacctttggagaaccttccactggaagttgtcacaagcacagcagaagtgaaagataacaaagccataaatgtatgatattagtgcccatgatgcagcagctaatttcaaacctaccactgcatgacagttttagtttgcctttttgcctctggtgggcatgaagactgagcaaagctgggaatcctgcagaaaagagtgtgaggagccagggaaaggcagaaccacctccatgctgtagcaaacaatttctagatactagaagcataatagaaacatttttctgtacaggtattaaactactggtctgtttgacagactttggtaacaatccaaagaccctgagggtctgagcagctagaagtcctagacaaagaacttgtggatgacttttgtcccatgtggcttttgtgaagtatggcaaaggtttttcatgagtgcctgattgttattcctgaacaatatccatagcactgttggcctcaggagtgcacagctcctgctgatgtatttttctttttgtgaaggcaaagggacaattatcactgcatgtcatctcctagacaatcagtcaaatagagctggtggccagtggttagctattcgcacgttatttgccatgtaaatgaaaacgtctttatttatcaaaaaaacacagaggctatttttatatccttggtatgaaatatgtatttaaactatttaaatatttataaagaaatgaatgttttcttttcattttggtaaaaaaaaagcttgctgttttaacaagaaatgcactactgttgtgtatagtagatcaaaaattatttattactaagaggatgtagtttccaaaggaatcccccattttttctgcatgcagtttgcaacaaatgtattctcatgcttctggattataaaagaaaagtgaagtcatattttgttaatgaaataaaaacatggactgagtgtcaactacatgagctttggcatggggatagagaggctccatctaggctctgccaactcatgtcaatgacatgatttaaggtcgttgtgccagcagaaatgtctctcctctaggtatcgtattttgttgctcaagaatccaaaatgggtctgtggacatagggcaatttggggctcaaagtgagggagaaaacctgggtgtgtcctttcccagtgcttttcttttacaagaggtagtagactagtggaaatccccaaatggagccaagacttctgagctataacttgtgggagtaataccagcttgcaatgggtcagcactttaccttttttctttaaggctcccaacaatgctatacagcgcagttgtttccattcctatttttaataaatctcaggggaagcctcagagattacacagttaggatgctgacacagtctagaatccataatgctccctacatctcacactaacaggcaaattcagatgctgggattggcaatgatttaagcaccttcactaaagtcttattttatgttttagaacagttacagtctaattgtcttggacattttgggaagatatattgggttcacattctggagttctctttattttccaccacaaaaaataatctgagaattgtatcattaaaagtatctaaacacaccaa

SEQ ID NO: 168209 - DNA, 5082 bp, Homo sapiens
  Payload ID: 13095
  Gene Symbol: KCNH8
  Gene Name: potassium channel, voltage gated eag related subfamily H, member 8
  ENST ID: ENST00000452398
  CDS Start-End: 187-774
gccggggcggctggaactctctccctttctccctccatccttccacttcccctgctcggccccgccgtcaggccgggtcccccttccctgccgtcatcaggttccccttctcccttcttggcactttcctttcgaaccatccttctggacaaactttgatggagaatttcacaccacgctggaaaaatgccggttatgaaaggattactggcgccgcaaaacaccttcctggacaccatcgccacccgttttgacggaacacatagcaacttcatccttgccaatgcccaggtggctaagggtttccccatagtctactgttccgatggcttctgcgagcttgctggatttgcccgaactgaagtcatgcagaagagttgtagctgcaagttcttatttggggttgaaaccaatgagcaactgatgcttcaaatagaaaagtcactggaggagaaaacagaattcaaaggagaaattatgttctacaagaaaaacgggtctccattttggtgcctactggatattgttcccataaagaatgaaaaaggagatgtagtactttttctggcctcgttcaaagatataacagatacaaaagtgaagattactccagaagataaaaaagaagacaaagtcaaaggaagatcaagagcagggacccactttgactcagcccggagacggagtcgagcagtcctttatcacatctctgggcacctgcaaagaagagaaaagaacaaattgaaaataaataacgtacttcaggatccctgaacacatcacattaatctgcccttccctcaatgagtgagacaagaacacaacattgtgacctacaaaatgtttttgtagataaaccagcatttccggagtataaagtttctgatgcaaaaaagtccaaattcatacttctgcattttagcacttttaaagctggctgggactggcttattttgttggcaacgttttatgttgctgtgactgtaccttacaacgtttgctttattggcaatgacgacctgtccacaactcggagcacaaccgtcagtgacattgcagtggagattctttttattatagatattattttaaatttccgaacaacttatgtcagcaagtctggccaagttatctttgaagcaagatcaatttgcatccactatgtcacaacctggttcatcattgatttaatcgctgccctgccttttgatcttctgtatgctttcaacgtcacagtggtgtctctcgtgcatcttctaaagacagtgcgcctcttgcgtcttttgcgtctgctgcagaagttagaccgctattcccaacacagtactatcgtcctgactctgctcatgtccatgtttgcactccttgcacactggatggcgtgtatctggtacgtcattggaaaaatggagagggaagacaacagccttctgaagtgggaagttggttggcttcatgagttgggaaagagactggaatctccatactatggcaacaataccttggggggcccgtcgatccgaagtgcctatattgccgctctgtacttcacgctgagcagcctcaccagcgtgggttttgggaacgtctctgctaatacagatgcagaaaagatcttctccatctgcaccatgctgattggtgccttgatgcacgccttggtgtttggaaacgtgacagcaatcatacagaggatgtactccagatggtccctctatcacactagaactaaggatctgaaagatttcatccgtgtccatcacttgccccaacaactcaagcagaggatgctcgaatattttcaaacaacctggtcagtcaacaatggaatagattcaaatgaggtaatgttcatttctcatgttgttttcaggcagaaagcacatattctaaggtaaacgcaagatgttctaatgcaggtatcagaagtgaaaagcataccaacttctttattcctttacatttttaattattcatgaatcccaatccatcttctttcacttgctttggcttgtgttttcacaatgccaatttggattgaccgaagttttatattaacttgctgcttattcgatcaggtggatttattttccttcttattgtctcttttcaaaggaatcaattcttacgataatttaacagtgtaatctgggataattatattaatcaagtttctgtttcccttaacatcaataaagttaaaaaattccatcaaaggggttatctttatacttccagaaacaccccagactgccactataaaaacagtattatataaatcaacgaaccatttcatcaacccaccagccaaacctgtaaccaacattttagtagtgattaattggtttctcctctcttcgcataatcaccagtgggtccaaattccatatcttctgtcctgactaggactctctgtgagaaggaagtcacaatgagttatatgttttcctgctagaggcttttttaatttgttctgtttctccagacttcttatcagctgattattcagtagcacataattcacagtcactgaaaaatctctccaggattatacatacttagatttcctcttctgtatgctggatggccaaacagcaggagacagtaggaagagcatccctgctgtcttgcaaagtaaatcagttagactacacttaccccaatttgatttcctccttcatcttctctgacagcttttgaaagactttccagatgaactgcgttctgacatcactatgcacttgaacaaggagatcttacagttgtccctttttgaatgtgccagccggggctgcctcaggtctctgtctctacacatcaaaacctctttctgtgctccgggggagtatctgctgcgtcaaggggatgctttgcaggccatctactttgtatgctcgggctccatggaagttcttaaagacagcatggtgctggctattcttgggaaaggggatttaattggagcaaatctatcaattaaggaccaagtgatcaagaccaatgcagatgtaaaggctttaacctactgtgatctccagtgtatcatcctcaaaggactctttgaagtgctagacctttacccagaatatgctcacaaattcgtggaagacattcagcatgacctcacatacaacctccgagaaggtcatgagagtgatgtgatatcaagactatcaaacaaatctatggtctcacagtcagagcccaagggaaatggcaacatcaacaagcgactcccatccattgtggaagatgaggaagaggaggaggagggggaggaagaggaggcagtctccctctctcccatctgcacaaggggatcttcttcgcgcaacaagaaggttggaagcaataaagcctacctgggcttaagcttaaagcaactggcctcgggaacggtgccctttcactcgcctatcagagtctccaggtcaaattcccccaaaaccaagcaggaaattgacccccccaaccataataaaaggaaagagaagaacttgaaattgcaactttcaactttgaataatgctggacccccagacctcagtccaaggattgttgatggaattgaagatggaaacagcagtgaagaaagtcagacttttgattttggctctgaacgaatcagatcagagcccagaatttctcctcctcttggagatccagagattggagctgctgttctcttcatcaaagcagaggagaccaagcagcagataaacaaactcaacagtgaggtaacaacattgactcaggaagtttctcagttgggtaaagacatgagaaatgtgatccagcttctggaaaacgttctgtcacctcagcagccatcacggttttgctctttgcacagcacctctgtgtgtccctccagggagagcttacagaccagaacgagctggagtgcacaccagccttgcctacacttgcaaacaggcggggctgcttatacccaagcacaactttgtagcagtaatatcacctcagacatttggagtgtggatccctcctctgtggggagcagcccccaacgaactggagctcatgagcaaaatcctgcagacagtgaactttatcattctccaagccttgattattcaccttcccactaccaggttgtccaagaaggtcatttgcaatttttaaggtgcatctctccacattcagattctacgttgacgcctctgcagtccatttcagcaactctctcatcttctgtctgctcctcttcggaaacatctttgcacctagttctcccaagcagatcagaggagggcagcttcagtcagggaactgtgagttccttcagtctggaaaacttaccaggatcttggaaccaggaaggaatggcatcagcttctacaaaacctttggagaaccttccactggaagttgtcacaagcacagcagaagtgaaagataacaaagccataaatgtatgatattagtgcccatgatgcagcagctaatttcaaacctaccactgcatgacagttttagtttgcctttttgcctctggtgggcatgaagactgagcaaagctgggaatcctgcagaaaagagtgtgaggagccagggaaaggcagaaccacctccatgctgtagcaaacaatttctagatactagaagcataatagaaacatttttctgtacaggtattaaactactggtctgtttgacagactttggtaacaatccaaagaccctgagggtctgagcagctagaagtcctagacaaagaacttgtggatgacttttgtcccatgtggcttttgtgaagtatggcaaaggtttttcatgagtgcctgattgttattcctgaacaatatccatagcactgttggcctcaggagtgcacagctcctgctgatgtatttttctttttgtgaaggcaaagggacaattatcactgcatgtcatctcctagacaatcagtcaaatagagctggtggccagtggttagctattcgcacgttatttgccatgtaaatgaaaacgtctttatttatcaaaaaaacacagaggctatttttatatccttggtatgaaatatgtatttaaactatttaaatatttataaag

SEQ ID NO: 168210 - DNA, 3245 bp, Homo sapiens
  Payload ID: 13096
  Gene Symbol: KCNQ1
  Gene Name: potassium channel, voltage gated KQT-like subfamily Q, member 1
  Uniprot ID: P51787
  ENST ID: ENST00000155840
  CDS Start-End: 109-2139
gcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgct

SEQ ID NO: 168211 - DNA, 2159 bp, Homo sapiens
  Payload ID: 13096
  Gene Symbol: KCNQ1
  Gene Name: potassium channel, voltage gated KQT-like subfamily Q, member 1
  Uniprot ID: P51787
  ENST ID: ENST00000335475
  CDS Start-End: 275-1924
ctcttcccttcctcccctgcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggacttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccc

SEQ ID NO: 168212 - DNA, 229 bp, Homo sapiens
  Payload ID: 13096
  Gene Symbol: KCNQ1
  Gene Name: potassium channel, voltage gated KQT-like subfamily Q, member 1
  ENST ID: ENST00000380776
  CDS Start-End: 8-229
gaaatggatggggcatgctgcttccagcacccactgggtgcagctgtctgctgtctgctgtcctgggggaaggtctggagagggcctctcgattcaagaaattaagcatacggtcacgagagtgcaaagttctgtgaaacgctccagtggttacacgccccggggtttcagcttcgaccctggcttcctcatcgtcctggtctgcctcatcttcagcgtgctgtccacc

SEQ ID NO: 168213 - DNA, 582 bp, Homo sapiens
  Payload ID: 13096
  Gene Symbol: KCNQ1
  Gene Name: potassium channel, voltage gated KQT-like subfamily Q, member 1
  ENST ID: ENST00000496887
  CDS Start-End: 3-582
agatgacacgagcggggctaagcagcacgcgccgcccggtgttggcgcgcacccacgtccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgt

SEQ ID NO: 168214 - DNA, 1624 bp, Homo sapiens
  Payload ID: 13096
  Gene Symbol: KCNQ1
  Gene Name: potassium channel, voltage gated KQT-like subfamily Q, member 1
  ENST ID: ENST00000632153
  CDS Start-End: 1-517
gctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtgtgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatacaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgcta

SEQ ID NO: 168215 - DNA, 752 bp, Homo sapiens
  Payload ID: 13096
  Gene Symbol: KCNQ1
  Gene Name: potassium channel, voltage gated KQT-like subfamily Q, member 1
  ENST ID: ENST00000632981
  CDS Start-End: 1-517
gctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtgtgagttgttaccc

SEQ ID NO: 168216 - DNA, 2750 bp, Homo sapiens
  Payload ID: 13097
  Gene Symbol: KCNQ2
  Gene Name: potassium channel, voltage gated KQT-like subfamily Q, member 2
  Uniprot ID: O43526
  ENST ID: ENST00000344462
  CDS Start-End: 47-2572
ccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttaca

SEQ ID NO: 168217 - DNA, 1426 bp, Homo sapiens
  Payload ID: 13097
  Gene Symbol: KCNQ2
  Gene Name: potassium channel, voltage gated KQT-like subfamily Q, member 2
  Uniprot ID: O43526
  ENST ID: ENST00000344425
  CDS Start-End: 178-1359
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaaaccccactttttgttgttcattattttgattgattttttttctttaaaatgtatttttcacaaagga

SEQ ID NO: 168218 - DNA, 2594 bp, Homo sapiens
  Payload ID: 13097
  Gene Symbol: KCNQ2
  Gene Name: potassium channel, voltage gated KQT-like subfamily Q, member 2
  ENST ID: ENST00000357249
  CDS Start-End: 1-2187
atcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgagga

SEQ ID NO: 168219 - DNA, 3253 bp, Homo sapiens
  Payload ID: 13097
  Gene Symbol: KCNQ2
  Gene Name: potassium channel, voltage gated KQT-like subfamily Q, member 2
  Uniprot ID: O43526
  ENST ID: ENST00000359125
  CDS Start-End: 128-2746
gagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtcccggtggggtttccgggcagctacaggcgggtgtggccggccgctgtgcgtg

SEQ ID NO: 168220 - DNA, 2775 bp, Homo sapiens
  Payload ID: 13097
  Gene Symbol: KCNQ2
  Gene Name: potassium channel, voltage gated KQT-like subfamily Q, member 2
  Uniprot ID: O43526
  ENST ID: ENST00000360480
  CDS Start-End: 43-2577
gctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggg

SEQ ID NO: 168221 - DNA, 3004 bp, Homo sapiens
  Payload ID: 13097
  Gene Symbol: KCNQ2
  Gene Name: potassium channel, voltage gated KQT-like subfamily Q, member 2
  ENST ID: ENST00000370224
  CDS Start-End: 136-2436
cccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccaggatagatatgattgtgggtcccccgcccccttcaactccccggcacaagaagtaccccaccaaaggacccacggcccctccgagagagtcaccccagtactcacctagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctgggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattc

SEQ ID NO: 168222 - DNA, 1139 bp, Homo sapiens
  Payload ID: 13097
  Gene Symbol: KCNQ2
  Gene Name: potassium channel, voltage gated KQT-like subfamily Q, member 2
  ENST ID: ENST00000626962
  CDS Start-End: 1-1139
gttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaag

SEQ ID NO: 168223 - DNA, 1109 bp, Homo sapiens
  Payload ID: 13097
  Gene Symbol: KCNQ2
  Gene Name: potassium channel, voltage gated KQT-like subfamily Q, member 2
  ENST ID: ENST00000627416
  CDS Start-End: 1-1109
gttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaag

SEQ ID NO: 168224 - DNA, 716 bp, Homo sapiens
  Payload ID: 13097
  Gene Symbol: KCNQ2
  Gene Name: potassium channel, voltage gated KQT-like subfamily Q, member 2
  ENST ID: ENST00000625248
  CDS Start-End: 1-462
acatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgccccgagtcgccagcgggcgtccagcctgccctcaggggtgtgagcaggcccttcgtgtgactagagcctgcggtcccacagatcacgctgaccaccattggctacggggacaagtacccccagacctggaacggcaggctccttgcggcaaccttcaccctcatcggtgtctccttcttcgcgctgcctgcagttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaaaccccactttttgttgttcattattttgattgattttttttctttaaaatgtatttttcac

SEQ ID NO: 168225 - DNA, 1145 bp, Homo sapiens
  Payload ID: 13097
  Gene Symbol: KCNQ2
  Gene Name: potassium channel, voltage gated KQT-like subfamily Q, member 2
  ENST ID: ENST00000629518
  CDS Start-End: 1-1145
gttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaag

SEQ ID NO: 168226 - DNA, 2925 bp, Homo sapiens
  Payload ID: 13097
  Gene Symbol: KCNQ2
  Gene Name: potassium channel, voltage gated KQT-like subfamily Q, member 2
  ENST ID: ENST00000625514
  CDS Start-End: 93-2357
ggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccaggatagatatgattgtgggtcccccgcccccttcaactccccggcacaagaagtaccccaccaaaggacccacggcccctccgagagagtcaccccagtactcacctagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctgggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattc

SEQ ID NO: 168227 - DNA, 2399 bp, Homo sapiens
  Payload ID: 13097
  Gene Symbol: KCNQ2
  Gene Name: potassium channel, voltage gated KQT-like subfamily Q, member 2
  ENST ID: ENST00000629676
  CDS Start-End: 93-2030
ggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattc

SEQ ID NO: 168228 - DNA, 1229 bp, Homo sapiens
  Payload ID: 13097
  Gene Symbol: KCNQ2
  Gene Name: potassium channel, voltage gated KQT-like subfamily Q, member 2
  ENST ID: ENST00000627948
  CDS Start-End: 1-1229
gttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaag

SEQ ID NO: 168229 - DNA, 950 bp, Homo sapiens
  Payload ID: 13097
  Gene Symbol: KCNQ2
  Gene Name: potassium channel, voltage gated KQT-like subfamily Q, member 2
  ENST ID: ENST00000630648
  CDS Start-End: 1-886
gttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaaaccccactttttgttgttcattattttgattgattttttttctttaaaatgtatttttcacaaa

SEQ ID NO: 168230 - DNA, 716 bp, Homo sapiens; identical to SEQ ID NO: 168224
  Payload ID: 13097
  Gene Symbol: KCNQ2
  Gene Name: potassium channel, voltage gated KQT-like subfamily Q, member 2
  ENST ID: ENST00000629498
  CDS Start-End: 1-462

SEQ ID NO: 168231 - DNA, 585 bp, Homo sapiens
  Payload ID: 13097
  Gene Symbol: KCNQ2
  Gene Name: potassium channel, voltage gated KQT-like subfamily Q, member 2
  ENST ID: ENST00000628732
  CDS Start-End: 1-585
agacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaag

SEQ ID NO: 168232 - DNA, 1145 bp, Homo sapiens; identical to SEQ ID NO: 168225
  Payload ID: 13097
  Gene Symbol: KCNQ2
  Gene Name: potassium channel, voltage gated KQT-like subfamily Q, member 2
  ENST ID: ENST00000628544
  CDS Start-End: 1-1145

SEQ ID NO: 168233 - DNA, 9213 bp, Homo sapiens
  Payload ID: 13097
  Gene Symbol: KCNQ2
  Gene Name: potassium channel, voltage gated KQT-like subfamily Q, member 2
  Uniprot ID: O43526
  ENST ID: ENST00000626839
  CDS Start-End: 215-2779
ggagccggcgcggccgcgggccaggcgccgaggtgcgcgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtcccggtggggtttccgggcagctacaggcgggtgtggccggccgctgtgcgtggcctctgccttcacacctgacctgcccggcgggctttcctgttccccacctcaggggcgcccaaatacagagctattggttggcgtcttctccctgtaccttctgggatctgagggctctttccatggaagccagccccgaggtggagaccttcgcctgcagccgaggagcgggtggggcctgggaaccaaactggagccagagtggacgtccagccctctggtcttggcctccagagggagggcctggctcacggtggggccagggagccggctccaaagggtcttcaaaaagggggtccttgggggctccagctgcctcgccctggcctttctgtgggtgcgtgagagccagcagcaccccagccttggagaccgggggggcaggaccccaagtcctcccctctctcctgactgccctggccgggtgccggcactgcgagacccacctggtgagcaggcctcacagttcttagccagggccccacctcgcctgtgtcccaccagtgccccgacagacctggggcagggctgggccatgatgcagcgggccaggatagcctccaccgtcagcacagggccgccctccccgcctttccggaggaaaccactcccacctcagcccagctgtgcgccctccctagctctcctgccccctggagctgatggccccttctccactgaccgattccttagcggggcctcttggggtctcgggcctcgggtgcaccgtcccatgcccgtcctgttgtgggcaccgtggcccttggggcaggcggctctaatgcgggagcgagtccctagctccagacttaagaaccagaccccgggagcatctggcatttggcgtgacggcgtcgcaggcgggcctgggctccctggagagtggcctccctgggagtgagcagggctggggtcgtgggcgcaaatactcctgcagagcaagtgcaggggagtcctgggcccgtttctcctccacctgcgttttcagtgcacttggcttggctgggaggtcctgaggccctgaggccagcaggggaaccagtcctgagggagaggactttgaaagcagcatttgagggtcgtacgcccctggctggtgggggtcctggcgctcagggtgttcggggagccatgtctggcgtccattgtggggagctgctgccctggcctctctgcctacccccagcccggccagggcactcccaggccctgtcgccattgaggtgcctccgctgggctgtctcctcacccctccctgtgctggagcctgtcccaaaaaggtgccaactgggaggcctcggaagccactgtccaggctcccactgcctgtctgctctgttcccaaaggcagcgtgtgtggcctcgggccctgcggtggcatgaagcatcccttctggtgtgggcatcgctacgtgttttgggggcagcgtttcacggcggtgcccttgctgtctcccttgggctggctcgagcctggggtccatgtccctttgccgtcccgtcatggggcagggaatccatagcggggcccacaggcaggggtatgagtgcgtcccacccaacgcagcaccagccccggccaccgctccccgtgtccccagttccgtctcagctacctggactccaggaccctggagaagggagacctggcagtggagggaggctgtgctgtgtgtccccctgcaggtgtgaccccgcctgctctttcctcccccgccaggtgtggccccgcctgctctttcctcccccaccagtatggccccacctgctctttcctccccccccaaggtgtggccccacctgttctttcctcccctgccgaggtgtgaccccacctgctctttcctccctcccagtatggccccacctgctctttcctcccccgaggtgaggccccgcctgctctttcctcccatggggccgctgaggcatgagcacctgggcacaggttggggctctgcaggatgaggaagacaggccaatcccttccctcccagaagctggccgcccagcaggagggactgaggccagactcatgtccagcaaggaacgtgtggtgtgtcccctgggaagtctctgggccctgggaagagggaaggtgcacgtcctgggatggttgcggggccctgttttgggagacaaaggggtagagggtctgtcttgggcccccccagactctagcctgagcagtgcagccacctactgccccacctcagagaagtgcagcgggaaggaggctggaggtggtgcggcgctgcctcgggtgtctgcgtgaatgagcgtggccaaggaccagtgccacctcatggcaaagagctcccgcagtgtttgttagagtgcacatccctacgtgcccactggcacacacacgtgctcacatacatgtccgcatacaggcgtacacatgcacgcttgcacacatgcacacagaccacatagcacacatgtgcactgaccacacctgtatagaccatgcacagtacacatacgtgcatacacatgcctgcatacaggcatacacatgcacgcttacatgtacacgtgcacagatcacacacatgcacacacgtgtagctcacacacagtatacacatacacaagtgcacagaccacacacagcactaacacatgcacacacaaagtgcataggccacacagcacatgcacacaggtgcacagaccacacagcacacacaagtgcacagagcacactgcacacatgcacacacacacgcgtgcatgcacactcctcgcacttccagccttggagcccttctgtctctggtctttctctttgaccctgctgagtgtaagctgcctggggaggggctacaaggagtaattgtggctttaggggtcgtggtgatgctggaatgtcaagcgccgtcgtggggtatccgactgtccgggctcctggtccgcagtggcagagcgccaggcagagcccaatcagggtctcgtgctgcccttccctcccacagcctggcagccatccagaggaggggctctaccagatgccaaggtgccccggtgtctgtatgggtgtccggttgggtcctgtgtttggtctgccctggaggtgctgggccctcctgggatgggtggctcagcctcgaatcccaggccccagcccaggcaggtgctgctgcctgttgtggtttcctggcccagcttctccttctccctctgcataaaatcacagtccgtgagtcttccagctgccaccacggctgggacacgctgggggagggctcctcccatgcctcctgcacacagccgtctgagcagggcaggtgcccaacaccccccaccggaggacacgctgcccctcagcgatgcccctaccttttggggggcctcgtctcaagcccccccttggaggctgaaatcaccccaggcactgtgagggcttctccagggggcaccctttgagctgtgggtctgatcaccccaagtcccgcccggaggagaggcacagccagggcgtgtggtttaatgtttgcccccttcggggctggaggtctcagtgtttctagattccagaccctgctgccagagagacctgctgccggagagaaggggaggaggactccagctgggctcggtcccccacagtcagggacccccataaaggacacccccttctctctagaaagagctgggctctcagctatttctagttgcttcccagaagccgaggagcagaaggagctgtgagagctttgcagaaacgcccttgtccccgccctcctgagctatgaatgccgtacagagcagaggctggggcattggcaagatcacaggttgatgctgcacagccccattgacacaaaccctcaaagcagacgtgagagggacggttcacaaagctcggacctgccgtggagggtgcccggcagacgtggcgtgagagggacggctcacgaggcttggacctgctgtggagggtgcccagcagacgtggtgtgagaggaacggctcacgagacttggacctggtggagggtgcccagcagacgtggtgtgagagggacggctcacagggcttggacctgccatggagggtgcccggcagacgtggtgtgagagggatggttcacagggcttggacctgccatggagggtgcccggcagatgtggtgggagagagatggctcatgaggcttggacctgccgtggagggtgcccagcagacgtggtatgagagggatggctcacgaggcttggacctggtggagggtgcccggcagacgtgtgagagggacggttcacaaggcttggacctgccatggagggtgcccagcagacgtggtgtgagagggacagctcacgaggcttggacctgctgtggagggtgcccagcagggggctgagctctgaggggtgggtgctcagtgcacgggtgcccccagtgtcctctgatcctgtccggtgcctcccccaacccccacacccatgcagaactcccaggtcacatgcacgtatgtccagggcatgggggtggcgtgaagaggcctggtcagggcctttaggggctgcaggacggaatggccgcctggggagcctgtgtggctgtgccgggcagccatcctgcattcccacccagcgcgcagtctccacctcggccccagcaaagcgctaagcagccggagagacagccagggcggcttcctgaaggatgtgggatggtggactccggggtcgagggaatacgcaggttcctgtccctccgggagacctagagaagctgcacacccaggagctttccatgacccgggagcatgagtgaatgggggttccagtttgctgaactttgccgtcttgtaagggtgggggctgacggccgaccctgggaggaggtgacatcgccgggggaggttgtgggcaacggtggaggaggagagacgggaggggaccatttgggatggaggggcctcttcagagttttaaaaggcgtttgtggggtggagttgagtgtgctctgggcttggacacttgccgtggtgcccctggctggccgaggagactggctctggccaggggccccgtcctgagaggtcctcagcgtctgactctcggccaggcgccagcaaggaggggccggtccccggggctaccaggcaggcacgtgcacatcgccatcgccacacgccaactccgcctgggttttacaaagtcgttgccttaatgcatgtggacaggaactccctgaggtcgccccatgccccctggctgtgccaggtacggacgccctggaccctgcgaacaggtggggcgggcgaggggcccaagggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattcaacctg

SEQ ID NO: 168234 - DNA, 1145 bp, Homo sapiens; identical to SEQ ID NO: 168225
  Payload ID: 13097
  Gene Symbol: KCNQ2
  Gene Name: potassium channel, voltage gated KQT-like subfamily Q, member 2
  ENST ID: ENST00000629641
  CDS Start-End: 1-1145

SEQ ID NO: 168235 - DNA, 1175 bp, Homo sapiens
  Payload ID: 13097
  Gene Symbol: KCNQ2
  Gene Name: potassium channel, voltage gated KQT-like subfamily Q, member 2
  ENST ID: ENST00000628790
  CDS Start-End: 1-1175
gttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaag

SEQ ID NO: 168236 - DNA, 1145 bp, Homo sapiens; identical to SEQ ID NO: 168225
  Payload ID: 13097
  Gene Symbol: KCNQ2
  Gene Name: potassium channel, voltage gated KQT-like subfamily Q, member 2
  ENST ID: ENST00000626723
  CDS Start-End: 1-1145

SEQ ID NO: 168237 - DNA, 2853 bp, Homo sapiens
  Payload ID: 13097
  Gene Symbol: KCNQ2
  Gene Name: potassium channel, voltage gated KQT-like subfamily Q, member 2
  ENST ID: ENST00000629241
  CDS Start-End: 93-2285
ggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctgggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattc

SEQ ID NO: 168238 - DNA, 545 bp, Homo sapiens
  Payload ID: 13097
  Gene Symbol: KCNQ2
  Gene Name: potassium channel, voltage gated KQT-like subfamily Q, member 2
  ENST ID: ENST00000629318
  CDS Start-End: 1-540
cggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccaggcaagagccccgcctgcctgtccagcaggggacaagaacggggtgggcttctgggacaaagcccactgtggcccatggtgggagtgcagggggtgtgtgggcggggcctcctccccacccacgtcggcctctgtcagcttctgttgtgtcttcacaaagtctgttttaatattt

SEQ ID NO: 168239 - DNA, 133 bp, Homo sapiens
  Payload ID: 13097
  Gene Symbol: KCNQ2
  Gene Name: potassium channel, voltage gated KQT-like subfamily Q, member 2
  ENST ID: ENST00000630933
  CDS Start-End: 1-133
cggtcacccagcgccgaccagagcctcgaggacagccccagcaaggtgcccaagagctggagcttcggggaccgcagccgggcacgccaggctttccgcatcaagggtgccgcgtcacggcagaactcagaag

SEQ ID NO: 168240 - DNA, 688 bp, Homo sapiens
  Payload ID: 13097
  Gene Symbol: KCNQ2
  Gene Name: potassium channel, voltage gated KQT-like subfamily Q, member 2
  ENST ID: ENST00000627221
  CDS Start-End: 1-688
agacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagcaagcctccccggagaggacattgtggatgacaagagctgcccctgcgagtttgtgaccgaggacctgaccccgggcctcaaagtcagcatcagagccgtgtg

SEQ ID NO: 168241 - DNA, 1093 bp, Homo sapiens
  Payload ID: 13097
  Gene Symbol: KCNQ2
  Gene Name: potassium channel, voltage gated KQT-like subfamily Q, member 2
  ENST ID: ENST00000629338
  CDS Start-End: 1-1093
atcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaag

SEQ ID NO: 168242 - DNA, 804 bp, Homo sapiens
  Payload ID: 13097
  Gene Symbol: KCNQ2
  Gene Name: potassium channel, voltage gated KQT-like subfamily Q, member 2
  ENST ID: ENST00000626684
  CDS Start-End: 1-577
ccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccaggtgagtccaggtgtcccccggggaccagcacagcccttgtcctggtcccaccttgttgaggagtggaggccgctggggctttggcattgccctgtctgtggatgggccacagcgctcaccctctgcaggaatctgtggaaggagcgaggatgtgaagtgtgtgtgttgagaaatggctccaacccctgaggctgcacaggggtggctcgtgtgaggacgctggggtggcccttgccttgtgtgggtgctggggcccggccatcaggtcctctctaccgcaccctgggaggtgagcacacccgttctgcagctgcagggccaaggctcctagagcccacacactgcagtgagtcagtgcctgacctcgtctgacccctgatgctggctgtgggcccccatgatgcccgcccggaccc

SEQ ID NO: 168243 - DNA, 11441 bp, Homo sapiens
  Payload ID: 13098
  Gene Symbol: KCNQ3
  Gene Name: potassium channel, voltage gated KQT-like subfamily Q, member 3
  Uniprot ID: O43525
  ENST ID: ENST00000388996
  CDS Start-End: 422-3040
ggctggcaccgggcttgtaaataaactgcgatgctgtcttgggctcgccggcctgggtgccgccgccgccgccgccgccccggagcgccggttccaggctcccgccgccgcgcgccctagcgcctccgcgccagcctcgcgcgccctcccagcttctccgcagcccccggcccgcgaccctcggggtcctgcggctgacccgcgcgggatgtgaccccctgaccccctgcctggcctcccctgccccccagggggcccgcctttgcctgcttttgggggggggtggggaggggcgcgcggatcatggcattggagttcccgggcttgcagccgccgccgccgcctcgttcacgcaccccgagcgccccttcttcccagagcagcagcggagaaggcgaagcggccggcgggggcgaggcagatggggctcaaggcgcgcagggcggcgggggcggctggcggcggcggcgacgggggcggcggaggcggcggggcggctaacccagccggaggggacgcggcggcggccggcgacgaggagcggaaagtggggctggcgcccggcgacgtggagcaagtcaccttggcgctcggggccggagccgacaaagacgggaccctgctgctggagggcggcggccgcgacgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaatcacgattggaccagtacagggagaaattactgatgagccatgctatttgtctgtttggttggctggtttgggttttggtttggtaagcagagaaagtagtttaagttatttctaggatcactgccctcttgtgtaaaacgctccagcaattaactgtttttgaaagcaaggaaataattttctcaacaaaaccacattgtgtatcagtggggctgcctactgagctaacattaggaaaggaatgagatagtcattgtgtctctaaaacaaagaatttaaacaaatatttaaggcaaaaccttttaaaagctctccaaaagacctcacttggcctgatgttacttagtatcatgcctcagtttccttatctgtaaaaagtggtggtaatcccaagtgtagcatttctgatgagttatgaattggcagggagaaaacacacacacacacacacacacacacacacacacacacatacacaaagttaaaatagtttccaatttatgtagccaaggacaatggaatttatcagaagtgaagtgcccctctgggcaggagctgagttcagtgcctttaaaatgaatttccaactctcatttcttcccatgatactgaagtacaaaatatccatctaaaatagaaattaaagtcaagaaggcacacagaaattttctagtccaaggacttccttttataaatgaagaatcttaggctcaggtaaagtgacatacccagagtcactcagttgtcccatagagaaccaggactcaaaagtcaggtctgcccactctccctgaccttgtttcccctcaccacaccattcttccatttatataatgcatcctagagattgtgtcaagatatatgactttgtgtcgcgtggaaagcacccagtttatccagcaggagggggatttccacttttattgcaaaacatgcttgcttgatgcaatgcatttcagatctagaaaaaaataatgcaagcaagctacatttacagatgtgtaaacaggcaaaatttccagaaccgtccaattttacttttccaaatttatggaaccaacccagattttttaaatgaaaatactaaaaccatatgtaaccgtaagacaagctaaaatgtaagcagacagcctgggaagcactgccctactgtacaggtgtgatattaagcacaagccatcctctggcctcttatgagatgttgttattctctgaaaaactttgatggaaaaggtttctgttaggcttagactgaattagctaaatgaccatgccacagtattattgtatcactcttctcacacacctaggcactggttgtggatagttgccatggtgacaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaagggcatgggttatttgggccttttccccactccttcaatatggctgaaagtgccagtggggattacaacctaagaaaccctatgccccttcctgagggcttgattattgaatcctgatcttcctggaatctttcacttgagatgatcacctgcctaacatccaacatgttactatgctcttctttatgtacatgagttactggaaaccaacaataaaggagagtgagtcatactctccacatatgcgccaattaattttttaacttacttattagtattcttgaagaacttactatcttaagtattttaccaatagatgatgcattttccagcaactcaatggagttctaccttaaagtatttaccattgatccaaaattggaggaactaccttagattcttttaataacctagaaaggattggagcttgtattatttcctaaaccataggcaggcagtctagcttccctgctggatcataagaccaggacagcagagattgggtttgtattgatcagtagtagggaagtattgattgtctaacatctagtaagttgtctttatcagtatagacatagacaaaatacatgttttatgaatgaataaataataagaaccttaagagctgtttttttcccatttaagaaaacaaaaaggaaaagagaaaaatgatcttctggaataactctgctttgatattctccttttgttccccaaaaaatatattccagaaaggcaaaccaaacctgctcaagttgcctatgcacagacaatctcaacaatatggctcacagtgagcaagcagaaattcagggtctggaattgaatgtgagttatgggaagaaacagtgtgtgctttcacaaagatccttttgtcagacaagggaacagcatgataatccaatggaactggttaacatgacccaagatgacatgaccacagatatactagtcgttctgaaacttgcccaagaaattgcaatcgtttcagcagaactccatgaaatattgacaaattaattccatcatcaaactaggagtgatattatcaggtaaaactatgatctcatgtatgtatttggtctttctgggtcacaatgtgacatgaaaaattttaaaggtcatattttagcaagatcaaaatgaattagataaatcaacttcacaaatgttaagcgaaacatgatcctattgagctgagaaagaagtacttgagatcgtttgagttttgactatcaaatgtcagcacaaaagcaaatatcaaaagcttaagaaaaaaattatttcaggaaaagaaaaacacatcaaattgagaaagtgttgttgaataactttgtttttagaactggaaatttaggcttattagacatgacattgatattacaaagccctagttttcatgaaaacataactagataaccccaaggtgtataggttaaaatgaactaattaatcaacaattatgcatcctgtgtctattttgtgcaaggtacttcctagacactgtagtttgaaagaataatttcctgtagaaaaacctaatctaataggacctactcataatttggcaaaatcatcctcataattccatgctactgaaatgggggtgtaataaagaaaaaatcatttgtttattcatttaacagggtttattaagcaccaatatatgcccagaactttgcagtgcactggaagttcagagataagaaaaccacagtttctgccatcaaaatgctaggaatctagaggtctcaaacatcagaggtcccttcaaactatgtctaccaggaaaataaaatacctgatttcatccctgcaaacaactctatacagacagaaatgcttcctagcttggaaactatagaaaattgaacatgaaaatgagagcaaaggttctacatcaaaatggcaatgatccaatcagcccagtcaaggctgagtgggttgaatggggacttcgagtttggattcaatgctttgaacttcatagctccagagaagctgtgcaaaaaggggggattctagggaatctgaggaagattgttggagaaaccagctttcttcttgtctcctaatccctgctaagattgataccagtcaaggagctgagttactttcatttcattatgttgaccaagagaagcttatgatacagactatgacacagcacctatttcaagagaaagatgttactctacttatgggaacctgcagatcaaattctcctggggcaagagaagaaatttgttcagcagcctaagaagtcaactgtactttggacagtgctgccaaacacaccccaggattctcccacccctgtgctttcccagaagatgccacatagctggtatttggttttcatgaataaccaaagattcttctttgcttcctgaaccccaggcatccttaggaatttgcttcatgtcctcacttgtccttgaaggcttgtttttcaggatgaacttttaaagtctaagttgtttatattcaaatcaacccaatgctattgttgctgatattaaaccattccaaactgagccaactggcccctaaacaagccagcaggcagcccctcactaatgcccagtttagaacatgttaggaccaggctatctgcatagctttagtggttttagaagccagtaatggcagtgtaaaagaggaatcatacagagatgacctggaagaaaatttgagtttcagcacattcaaaagcatttgactcttctgccgtgttttgattttcaagtgagacaatcaatgtacacacaaagcctctagtacaatgactgatgcatactagggactgttatttatgttatttttttacagtatgcatggacttcattgtctcagtctttggtgttacttataaactctaaatttacaccaaaaaaattttttttcagaaaaagaatcgtggagaaacaatcctaattattaaatcaaatgctttcacaattgctttttaaataagtacatctctgcaaataaaaatgcttgctcttgtctaccacaataaagaacagaaggaatcttggaatgaagagaggcaggaatgttggatctcagtggctgagttgtggcaattccattggacatatagtaccagatgttgcaccatctggatgatgtgtaggagataaagccaaattgcaaaaataaaagactcatgatttcccaaggaaagtcaactgtgcatggtggctatcagacaacaccctagcaatgaatgggggaacttgcagaagaaagagttaatgcttgcttaaaccttccctggggagatttgttcccaggctttcacggctttaacctcagcaaccctgtaagaaaattgtgattcatattttgatttgttatcatagatgcaaagagacataatttcatggattctaagatacacagagcaagaagagattttgatcacccagaacaaccacctgtctttttagatcaagaagcagaagctcagagcaaagaacatcacaccacgtccctcagtgattgaagcagtgattgagtcacagaataaatctggaactcaggtcttctgatctttgctccagatgttagagacaaaactaaaagtaaaataccaagtgaaatcaaagcatcacgattgagcccagaacatgaaaaagaacttcctggcccacttgagaaactgttaaaccggacatacctttggggacttcttcccttctctggaataagattgatgtttccatgctgtgaaagacgatgatgttccttctcccagattcctgctgtcttcaaaaggcctagcaaaaaccactgctgctgggtgcagttgagaaagggaatgaagaacaatcccatggccatgcaggcactcctcccctccacctctctgccctccacccctctgccctctcctaccttgttccttcttggtcctgccatgtttggactggttcacctttttggcccatcacttgggctcattcagcaacagtcatgccttaggttgcatcctcatctataggccaattaaacagggtttcttcttgataaatccctatggttttgattttaggaagtcaggcatgatttcttttgggatctatatgacccaaagtggccagttttaccaaaggtgtccctttgcactgggatctctgggtctcatttgaacacagcttgggtcctcttgccttgtcccagagaatccccatgttgtcaggacataagcagatactctagggccttcaccaaaagctacaaagaagcagacaggactcaacttaggacatcttatggttatgtaactaagagattattttaggaagtaaacaggcctctgttggctcaaatgaacatcttcattgttagtttccacttacattgttctcgggataaatcggccagaatttggcagggctccccagcagtccttgtgaatccctgtggtaggatgtttcagttctcctgagtcaggctgaagtgaaagctcctaagagatattcagaaagaaggatggtcaagttctagaacaacaatagttggcccagtaattttaaagattgtcattctacctaagccttcatcctccagatagcactgttatgggcttaaaataagcttcaagggaaataatgaatttctttgacaccgccaaaaatcggctgtatataagaataacttgagaatggcttacaatgaggtagtcaaaagcccagctcagtgctcaggaatgtatttgtaattcctcttagacttgtcgaatggactgcaatttgatacctaagagtaataaaaaatgagaccatattttatgttaatgttcccttctcttcctctgcccacaaaagtgaggtcagggaaggggagagaaacttatcctaagcactccttatgagttgcttgtgacatgatagctctctctaaagttcatgcaatcctcatcgcaaccccatgagggagatgttattgtctccatcttatagatgaggaaactgaagacaagaccttgtcaaaggtcacacattgtaagaagtagagctgcatattcaaccaaagcccgtgtacctggaaagctcattctctctcccccttcttcctctcaaatcaggccctagctcctccacaatgcttcgggcttctacgttcactcagctttacagtaaaatgatcacagacccatgagttccctggagagtagagtgatgcctgggtcagctgttcctcttgtctgttcagcaggtcctttgagtggcttcacaatccagctgtcagtggcagaaaataatgcctcataaattattcacctggttcacattggaatccattagctctcggggcttggtgtggctgcagatcatccacaagtgccccttgttctctgcccccaaggagctcctgtcattgtttttaaccaaacaagttcaaatatctccacgtctctgctgactctggtcttttgtctctagactgtacctttatttctgagctctgaaattctgcagaaacaggtgagtctataaaaacattctgtgggaggccaaaagctcagaacagttgtgtctctctttctcagtattaaaagatcaaggtttcccatggaagccaacctgatctggtaattgggcccttctatacccctctgaatacttttccaaggagggggcagttcccacccccatagttcccctgagggttaagagtccaggtggtggccaagttgcaagatttggggcagccattttgccaaggatcagagatttgctgttggagaggtgaagtcggctctgtgccatcctgaaaaatcaacttagaaagataggtggacttcatcagatttgtcagtccttccttgttttaaagagaaaaatgatctctgccttgcttcagataggatatggctattttttttccttctttttctaatgtagcagtgatggaaaacaccagtctttgaagaacaaatggaggttcccagtgacatgaatccattatatttgattttggattgtattttttaacccctttttatggcatagaattctggtgccttgctccctgggtttgtctctgtgctacgagtaggctttcttcacattctggcttacaggggaacacaactattccacaagtggcctttagtgctctttataatatgatttcctgtaatttttaaactgtatgtgtaatttatattctggctctgtccaatatttgaacaactttaataggttgatttccatatatattatgcaaataattcttacctgattttttatgttctatcttaaataaatactgcaccacttattaataaatagacatttcagtga

SEQ ID NO: 168244 - DNA, 2801 bp, Homo sapiens
  Payload ID: 13098
  Gene Symbol: KCNQ3
  Gene Name: potassium channel, voltage gated KQT-like subfamily Q, member 3
  ENST ID: ENST00000519445
  CDS Start-End: 47-2629
cagagcagcagcggagaaggcgaagcggccggcgggggcgaggcagatggggctcaaggcgcgcagggcggcgggggcggctggcggcggcggcgacgggggcggcggaggcggcggggcggctaacccagccggaggggacgcggcggcggccggcgacgaggagcggaaagtggggctggcgcccggcgacgtggagcaagtcaccttggcgctcggggccggagccgacaaagacgggaccctgctgctggagggcggcggccgcgacgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtca

SEQ ID NO: 168245 - DNA, 2576 bp, Homo sapiens
  Payload ID: 13098
  Gene Symbol: KCNQ3
  Gene Name: potassium channel, voltage gated KQT-like subfamily Q, member 3
  Uniprot ID: O43525
  ENST ID: ENST00000521134
  CDS Start-End: 37-2295
acttgttaaaaatcttgttcttgcattcattaccttatgaagcctgcagaacacgccacgatgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaa

SEQ ID NO: 168246 - DNA, 10659 bp, Homo sapiens
  Payload ID: 13098
  Gene Symbol: KCNQ3
  Gene Name: potassium channel, voltage gated KQT-like subfamily Q, member 3
  ENST ID: ENST00000621976
  CDS Start-End: 1-2256
aagccaaaaaagcatggtcctatgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaatcacgattggaccagtacagggagaaattactgatgagccatgctatttgtctgtttggttggctggtttgggttttggtttggtaagcagagaaagtagtttaagttatttctaggatcactgccctcttgtgtaaaacgctccagcaattaactgtttttgaaagcaaggaaataattttctcaacaaaaccacattgtgtatcagtggggctgcctactgagctaacattaggaaaggaatgagatagtcattgtgtctctaaaacaaagaatttaaacaaatatttaaggcaaaaccttttaaaagctctccaaaagacctcacttggcctgatgttacttagtatcatgcctcagtttccttatctgtaaaaagtggtggtaatcccaagtgtagcatttctgatgagttatgaattggcagggagaaaacacacacacacacacacacacacacacacacacacacatacacaaagttaaaatagtttccaatttatgtagccaaggacaatggaatttatcagaagtgaagtgcccctctgggcaggagctgagttcagtgcctttaaaatgaatttccaactctcatttcttcccatgatactgaagtacaaaatatccatctaaaatagaaattaaagtcaagaaggcacacagaaattttctagtccaaggacttccttttataaatgaagaatcttaggctcaggtaaagtgacatacccagagtcactcagttgtcccatagagaaccaggactcaaaagtcaggtctgcccactctccctgaccttgtttcccctcaccacaccattcttccatttatataatgcatcctagagattgtgtcaagatatatgactttgtgtcgcgtggaaagcacccagtttatccagcaggagggggatttccacttttattgcaaaacatgcttgcttgatgcaatgcatttcagatctagaaaaaaataatgcaagcaagctacatttacagatgtgtaaacaggcaaaatttccagaaccgtccaattttacttttccaaatttatggaaccaacccagattttttaaatgaaaatactaaaaccatatgtaaccgtaagacaagctaaaatgtaagcagacagcctgggaagcactgccctactgtacaggtgtgatattaagcacaagccatcctctggcctcttatgagatgttgttattctctgaaaaactttgatggaaaaggtttctgttaggcttagactgaattagctaaatgaccatgccacagtattattgtatcactcttctcacacacctaggcactggttgtggatagttgccatggtgacaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaagggcatgggttatttgggccttttccccactccttcaatatggctgaaagtgccagtggggattacaacctaagaaaccctatgccccttcctgagggcttgattattgaatcctgatcttcctggaatctttcacttgagatgatcacctgcctaacatccaacatgttactatgctcttctttatgtacatgagttactggaaaccaacaataaaggagagtgagtcatactctccacatatgcgccaattaattttttaacttacttattagtattcttgaagaacttactatcttaagtattttaccaatagatgatgcattttccagcaactcaatggagttctaccttaaagtatttaccattgatccaaaattggaggaactaccttagattcttttaataacctagaaaggattggagcttgtattatttcctaaaccataggcaggcagtctagcttccctgctggatcataagaccaggacagcagagattgggtttgtattgatcagtagtagggaagtattgattgtctaacatctagtaagttgtctttatcagtatagacatagacaaaatacatgttttatgaatgaataaataataagaaccttaagagctgtttttttcccatttaagaaaacaaaaaggaaaagagaaaaatgatcttctggaataactctgctttgatattctccttttgttccccaaaaaatatattccagaaaggcaaaccaaacctgctcaagttgcctatgcacagacaatctcaacaatatggctcacagtgagcaagcagaaattcagggtctggaattgaatgtgagttatgggaagaaacagtgtgtgctttcacaaagatccttttgtcagacaagggaacagcatgataatccaatggaactggttaacatgacccaagatgacatgaccacagatatactagtcgttctgaaacttgcccaagaaattgcaatcgtttcagcagaactccatgaaatattgacaaattaattccatcatcaaactaggagtgatattatcaggtaaaactatgatctcatgtatgtatttggtctttctgggtcacaatgtgacatgaaaaattttaaaggtcatattttagcaagatcaaaatgaattagataaatcaacttcacaaatgttaagcgaaacatgatcctattgagctgagaaagaagtacttgagatcgtttgagttttgactatcaaatgtcagcacaaaagcaaatatcaaaagcttaagaaaaaaattatttcaggaaaagaaaaacacatcaaattgagaaagtgttgttgaataactttgtttttagaactggaaatttaggcttattagacatgacattgatattacaaagccctagttttcatgaaaacataactagataaccccaaggtgtataggttaaaatgaactaattaatcaacaattatgcatcctgtgtctattttgtgcaaggtacttcctagacactgtagtttgaaagaataatttcctgtagaaaaacctaatctaataggacctactcataatttggcaaaatcatcctcataattccatgctactgaaatgggggtgtaataaagaaaaaatcatttgtttattcatttaacagggtttattaagcaccaatatatgcccagaactttgcagtgcactggaagttcagagataagaaaaccacagtttctgccatcaaaatgctaggaatctagaggtctcaaacatcagaggtcccttcaaactatgtctaccaggaaaataaaatacctgatttcatccctgcaaacaactctatacagacagaaatgcttcctagcttggaaactatagaaaattgaacatgaaaatgagagcaaaggttctacatcaaaatggcaatgatccaatcagcccagtcaaggctgagtgggttgaatggggacttcgagtttggattcaatgctttgaacttcatagctccagagaagctgtgcaaaaaggggggattctagggaatctgaggaagattgttggagaaaccagctttcttcttgtctcctaatccctgctaagattgataccagtcaaggagctgagttactttcatttcattatgttgaccaagagaagcttatgatacagactatgacacagcacctatttcaagagaaagatgttactctacttatgggaacctgcagatcaaattctcctggggcaagagaagaaatttgttcagcagcctaagaagtcaactgtactttggacagtgctgccaaacacaccccaggattctcccacccctgtgctttcccagaagatgccacatagctggtatttggttttcatgaataaccaaagattcttctttgcttcctgaaccccaggcatccttaggaatttgcttcatgtcctcacttgtccttgaaggcttgtttttcaggatgaacttttaaagtctaagttgtttatattcaaatcaacccaatgctattgttgctgatattaaaccattccaaactgagccaactggcccctaaacaagccagcaggcagcccctcactaatgcccagtttagaacatgttaggaccaggctatctgcatagctttagtggttttagaagccagtaatggcagtgtaaaagaggaatcatacagagatgacctggaagaaaatttgagtttcagcacattcaaaagcatttgactcttctgccgtgttttgattttcaagtgagacaatcaatgtacacacaaagcctctagtacaatgactgatgcatactagggactgttatttatgttatttttttacagtatgcatggacttcattgtctcagtctttggtgttacttataaactctaaatttacaccaaaaaaattttttttcagaaaaagaatcgtggagaaacaatcctaattattaaatcaaatgctttcacaattgctttttaaataagtacatctctgcaaataaaaatgcttgctcttgtctaccacaataaagaacagaaggaatcttggaatgaagagaggcaggaatgttggatctcagtggctgagttgtggcaattccattggacatatagtaccagatgttgcaccatctggatgatgtgtaggagataaagccaaattgcaaaaataaaagactcatgatttcccaaggaaagtcaactgtgcatggtggctatcagacaacaccctagcaatgaatgggggaacttgcagaagaaagagttaatgcttgcttaaaccttccctggggagatttgttcccaggctttcacggctttaacctcagcaaccctgtaagaaaattgtgattcatattttgatttgttatcatagatgcaaagagacataatttcatggattctaagatacacagagcaagaagagattttgatcacccagaacaaccacctgtctttttagatcaagaagcagaagctcagagcaaagaacatcacaccacgtccctcagtgattgaagcagtgattgagtcacagaataaatctggaactcaggtcttctgatctttgctccagatgttagagacaaaactaaaagtaaaataccaagtgaaatcaaagcatcacgattgagcccagaacatgaaaaagaacttcctggcccacttgagaaactgttaaaccggacatacctttggggacttcttcccttctctggaataagattgatgtttccatgctgtgaaagacgatgatgttccttctcccagattcctgctgtcttcaaaaggcctagcaaaaaccactgctgctgggtgcagttgagaaagggaatgaagaacaatcccatggccatgcaggcactcctcccctccacctctctgccctccacccctctgccctctcctaccttgttccttcttggtcctgccatgtttggactggttcacctttttggcccatcacttgggctcattcagcaacagtcatgccttaggttgcatcctcatctataggccaattaaacagggtttcttcttgataaatccctatggttttgattttaggaagtcaggcatgatttcttttgggatctatatgacccaaagtggccagttttaccaaaggtgtccctttgcactgggatctctgggtctcatttgaacacagcttgggtcctcttgccttgtcccagagaatccccatgttgtcaggacataagcagatactctagggccttcaccaaaagctacaaagaagcagacaggactcaacttaggacatcttatggttatgtaactaagagattattttaggaagtaaacaggcctctgttggctcaaatgaacatcttcattgttagtttccacttacattgttctcgggataaatcggccagaatttggcagggctccccagcagtccttgtgaatccctgtggtaggatgtttcagttctcctgagtcaggctgaagtgaaagctcctaagagatattcagaaagaaggatggtcaagttctagaacaacaatagttggcccagtaattttaaagattgtcattctacctaagccttcatcctccagatagcactgttatgggcttaaaataagcttcaagggaaataatgaatttctttgacaccgccaaaaatcggctgtatataagaataacttgagaatggcttacaatgaggtagtcaaaagcccagctcagtgctcaggaatgtatttgtaattcctcttagacttgtcgaatggactgcaatttgatacctaagagtaataaaaaatgagaccatattttatgttaatgttcccttctcttcctctgcccacaaaagtgaggtcagggaaggggagagaaacttatcctaagcactccttatgagttgcttgtgacatgatagctctctctaaagttcatgcaatcctcatcgcaaccccatgagggagatgttattgtctccatcttatagatgaggaaactgaagacaagaccttgtcaaaggtcacacattgtaagaagtagagctgcatattcaaccaaagcccgtgtacctggaaagctcattctctctcccccttcttcctctcaaatcaggccctagctcctccacaatgcttcgggcttctacgttcactcagctttacagtaaaatgatcacagacccatgagttccctggagagtagagtgatgcctgggtcagctgttcctcttgtctgttcagcaggtcctttgagtggcttcacaatccagctgtcagtggcagaaaataatgcctcataaattattcacctggttcacattggaatccattagctctcggggcttggtgtggctgcagatcatccacaagtgccccttgttctctgcccccaaggagctcctgtcattgtttttaaccaaacaagttcaaatatctccacgtctctgctgactctggtcttttgtctctagactgtacctttatttctgagctctgaaattctgcagaaacaggtgagtctataaaaacattctgtgggaggccaaaagctcagaacagttgtgtctctctttctcagtattaaaagatcaaggtttcccatggaagccaacctgatctggtaattgggcccttctatacccctctgaatacttttccaaggagggggcagttcccacccccatagttcccctgagggttaagagtccaggtggtggccaagttgcaagatttggggcagccattttgccaaggatcagagatttgctgttggagaggtgaagtcggctctgtgccatcctgaaaaatcaacttagaaagataggtggacttcatcagatttgtcagtccttccttgttttaaagagaaaaatgatctctgccttgcttcagataggatatggctattttttttccttctttttctaatgtagcagtgatggaaaacaccagtctttgaagaacaaatggaggttcccagtgacatgaatccattatatttgattttggattgtattttttaacccctttttatggcatagaattctggtgccttgctccctgggtttgtctctgtgctacgagtaggctttcttcacattctggcttacaggggaacacaactattccacaagtggcctttagtgctctttataatatgatttcctgtaatttttaaactgtatgtgtaatttatattctggctctgtccaatatttgaacaactttaataggttgatttccatatatattatgcaaataattcttacctgattttttatgttctatcttaaataaatactgcaccacttattaataaatagacatttcagtgatt

SEQ ID NO: 168247 - DNA, 4099 bp, Homo sapiens
  Payload ID: 13099
  Gene Symbol: KCNQ4
  Gene Name: potassium channel, voltage gated KQT-like subfamily Q, member 4
  Uniprot ID: P56696
  ENST ID: ENST00000347132
  CDS Start-End: 83-2170
agccatgcgtctctgagcgccccgagcgcgcccccgccccggaccgtgcccgggccccggcgcccccagcccggcgccgcccatggccgaggcccccccgcgccgcctcggcctgggtcccccgcccggggacgccccccgcgcggagctagtggcgctcacggccgtgcagagcgaacagggcgaggcgggcgggggcggctccccgcgccgcctcggcctcctgggcagccccctgccgccgggcgcgcccctccctgggccgggctccggctcgggctccgcctgcggccagcgctcctcggccgcgcacaagcgctaccgccgcctgcagaactgggtctacaacgtgctggagcggccccgcggctgggccttcgtctaccacgtcttcatatttttgctggtcttcagctgcctggtgctgtctgtgctgtccactatccaggagcaccaggaacttgccaacgagtgtctcctcatcttggaattcgtgatgatcgtggttttcggcttggagtacatcgtccgggtctggtccgccggatgctgctgccgctaccgaggatggcagggtcgcttccgctttgccagaaagcccttctgtgtcatcgacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggagctgatcaccgcctggtacatcgggttcctggtgctcatcttcgcctccttcctggtctacctggctgagaaggacgccaactccgacttctcctcctacgccgactcgctctggtgggggacgattacattgacaaccatcggctatggtgacaagacaccgcacacatggctgggcagggtcctggctgctggcttcgccttactgggcatctctttctttgccctgcctgccggcatcctaggctccggctttgccctgaaggtccaggagcagcaccggcagaagcacttcgagaagcggaggatgccggcagccaacctcatccaggctgcctggcgcctgtactccaccgatatgagccgggcctacctgacagccacctggtactactatgacagtatcctcccatccttcagagagctggccctcttgtttgagcacgtgcaacgggcccgcaatgggggcctacggcccctggaggtgcggcgggcgccggtacccgacggagcaccctcccgttacccgcccgttgccacctgccaccggccgggcagcacctccttctgccctggggaaagcagccggatgggcatcaaagaccgcatccgcatgggcagctcccagcggcggacgggtccttccaagcagcatctggcacctccaacaatgcccacctccccaagcagcgagcaggtgggtgaggccaccagccccaccaaggtgcaaaagagctggagcttcaatgaccgcacccgcttccgggcatctctgagactcaaaccccgcacctctgctgaggatgccccctcagaggaagtagcagaggagaagagctaccagtgtgagctcacggtggacgacatcatgcctgctgtgaagacagtcatccgctccatcaggattctcaagttcctggtggccaaaaggaaattcaaggagacactgcgaccgtacgacgtgaaggacgtcattgagcagtactcagcaggccacctggacatgctgggccggatcaagagcctgcaaactcgggtggaccaaattgtgggtcgggggcccggggacaggaaggcccgggagaagggcgacaaggggccctccgacgcggaggtggtggatgaaatcagcatgatgggacgcgtggtcaaggtggagaagcaggtgcagtccatcgagcacaagctggacctgctgttgggcttctattcgcgctgcctgcgctctggcacctcggccagcctgggcgccgtgcaagtgccgctgttcgaccccgacatcacctccgactaccacagccctgtggaccacgaggacatctccgtctccgcacagacgctcagcatctcccgctcggtcagcaccaacatggactgagggacttctcagaggcagggcagcacacggccagccccgcggcctggcgctccgactgccctctgaggcctccggactcctctcgtacttgaactcactccctcacggggagagagaccacacgcagtattgagctgcctgagtgggcgtggtacctgctgtgggtgccagcgccccttccccacctcaggagcgtgagatgccaggtcgcacagagggcagcagcagcggccgtcccgcggcctctgggccccccagtgccctgcccactccatcaaggccctatgtggcccacctggcaggggcacagccccgggagtgggagcgggcgctggggccctgggccctgacccagcttccagctatgcaaggtgaggtctctggcccacccttcggacacagcagggaagccctcccgccaagtccccgccccacttgggggtgggccaaggtgcccccacaggtacccacaaagcacaggaccctgccacaaggcaggtggacaccatatatgcaaaccatgttaaatatgcaactttggggacccccatggggtctctctgtccctcccccattgggagctgggcccccagcagtagctggtctcaggctgcttggccaccaccctgtccctattctttggcttatcactccttcccctcccagcatggggcctgtttctcccctgccctctcctaagggcaatgcctgggcctttcttcccatttgcaagtgtcagctcccaggggctccctcctcctgctgggtggccactcccctccttggccctccagacaccactcatagtcagcacaggtttctgtatcctccccaaaactcccagacagtgcttcgtggacgatcgcacaaacatagccttttagtttctccagacaggaagaaagcctctcacacttaaacatgcaatgacgtgacacacttggagacatgagtgcagagccactcagccgctcctgggcctctgcagcagatgccagtggactggccttgcagggtgacgaccactaagaggaagacccccaactccatctgagcaggagaaggagctttgaagtaacccgagagctctccaggccccacccagacctttacccgctccccttcttcaagaagatctcctcctctctggtccaggagccctaacccactgcctctgcctgtccccaagggcccgcctccgtgtctccacagcacaactcgggcccaggcctgacaccactggagagaccccaggcccacttctagccaggcctgtgccttcctagtcactctaactcccagagagaataagaatgcatgtaatagctataccaaccgcgcatccggctttcacatgcactgtctcccctccctccacaccccacttcttcacttcaattggcagcgccacatccaggcgtcagcccccattcactccaggaacactttcttatccccacccctttgctcctcttctgcaaagccaatgcaggtggcaggaaggtgaggggtagtggaccaatggcaaccctctgtgggaacaaggggccgaggccacgctgcctgcatctcgtgctggggacctgcatgcgccagcaccagggcttggactggatcttactcagtccatggtgcccagcctctgccccaacatgccctctgcatgtgaccgtcatgccctggatggagccactcctggctcaccccacctgcactgcactgtccccagagagccacccctccacccactcagagacagctgtggagagggccaggagaatgggattaccctatgaccaaggagacatgggaagaagccctccttccttccacgatcgaggttccgccatcaactcggttctcggatatgcaagtacctcactttgttaacttattaacttattggtttcattaaagttttcaagagga

SEQ ID NO: 168248 - DNA, 2435 bp, Homo sapiens
  Payload ID: 13099
  Gene Symbol: KCNQ4
  Gene Name: potassium channel, voltage gated KQT-like subfamily Q, member 4
  ENST ID: ENST00000443478
  CDS Start-End: 1-1669
atttttgctggtcttcagctgcctggtgctgtctgtgctgtccactatccaggagcaccaggaacttgccaacgagtgtctcctcatcttggaattcgtgatgatcgtggttttcggcttggagtacatcgtccgggtctggtccgccggatgctgctgccgctaccgaggatggcagggtcgcttccgctttgccagaaagcccttctgtgtcatcgacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggagctgatcaccgcctggtacatcgggttcctggtgctcatcttcgcctccttcctggtctacctggctgagaaggacgccaactccgacttctcctcctacgccgactcgctctggtgggggacgattacattgacaaccatcggctatggtgacaagacaccgcacacatggctgggcagggtcctggctgctggcttcgccttactgggcatctctttctttgccctgcctgccggcatcctaggctccggctttgccctgaaggtccaggagcagcaccggcagaagcacttcgagaagcggaggatgccggcagccaacctcatccaggctgcctggcgcctgtactccaccgatatgagccgggcctacctgacagccacctggtactactatgacagtatcctcccatccttcagccagatgtttaataataaacggagtttctttcggatccacgccagctggagaccgagcagccggatgggcatcaaagaccgcatccgcatgggcagctcccagcggcggacgggtccttccaagcagcatctggcacctccaacaatgcccacctccccaagcagcgagcaggtgggtgaggccaccagccccaccaaggtgcaaaagagctggagcttcaatgaccgcacccgcttccgggcatctctgagactcaaaccccgcacctctgctgaggatgccccctcagaggaagtagcagaggagaagagctaccagtgtgagctcacggtggacgacatcatgcctgctgtgaagacagtcatccgctccatcaggattctcaagttcctggtggccaaaaggaaattcaaggagacactgcgaccgtacgacgtgaaggacgtcattgagcagtactcagcaggccacctggacatgctgggccggatcaagagcctgcaaactcgggtggaccaaattgtgggtcgggggcccggggacaggaaggcccgggagaagggcgacaaggggccctccgacgcggaggtggtggatgaaatcagcatgatgggacgcgtggtcaaggtggagaagcaggtgcagtccatcgagcacaagctggacctgctgttgggcttctattcgcgctgcctgcgctctggcacctcggccagcctgggcgccgtgcaagtgccgctgttcgaccccgacatcacctccgactaccacagccctgtggaccacgaggacatctccgtctccgcacagacgctcagcatctcccgctcggtcagcaccaacatggactgagggacttctcagaggcagggcagcacacggccagccccgcggcctggcgctccgactgccctctgaggcctccggactcctctcgtacttgaactcactccctcacggggagagagaccacacgcagtattgagctgcctgagtgggcgtggtacctgctgtgggtgccagcgccccttccccacctcaggagcgtgagatgccaggtcgcacagagggcagcagcagcggccgtcccgcggcctctgggccccccagtgccctgcccactccatcaaggccctatgtggcccacctggcaggggcacagccccgggagtgggagcgggcgctggggccctgggccctgacccagcttccagctatgcaaggtgaggtctctggcccacccttcggacacagcagggaagccctcccgccaagtccccgccccacttgggggtgggccaaggtgcccccacaggtacccacaaagcacaggaccctgccacaaggcaggtggacaccatatatgcaaaccatgttaaatatgcaactttggggacccccatggggtctctctgtccctcccccattgggagctgggcccccagcagtagctggtctcaggctgcttggccaccaccctgtccctattctttggcttatcactccttcccctcccagcatggggcctgtttctcccctgccctctcctaagggcaatgcctgggcctttcttcccatttgcaagtgtcagctcccaggggctccctcctcctgctgg

SEQ ID NO: 168249 - DNA, 1926 bp, Homo sapiens
  Payload ID: 13099
  Gene Symbol: KCNQ4
  Gene Name: potassium channel, voltage gated KQT-like subfamily Q, member 4
  Uniprot ID: P56696
  ENST ID: ENST00000509682
  CDS Start-End: 1-1926
atggccgaggcccccccgcgccgcctcggcctgggtcccccgcccggggacgccccccgcgcggagctagtggcgctcacggccgtgcagagcgaacagggcgaggcgggcgggggcggctccccgcgccgcctcggcctcctgggcagccccctgccgccgggcgcgcccctccctgggccgggctccggctcgggctccgcctgcggccagcgctcctcggccgcgcacaagcgctaccgccgcctgcagaactgggtctacaacgtgctggagcggccccgcggctgggccttcgtctaccacgtcttcatatttttgctggtcttcagctgcctggtgctgtctgtgctgtccactatccaggagcaccaggaacttgccaacgagtgtctcctcatcttggaattcgtgatgatcgtggttttcggcttggagtacatcgtccgggtctggtccgccggatgctgctgccgctaccgaggatggcagggtcgcttccgctttgccagaaagcccttctgtgtcatcgacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggagctgatcaccgcctggtacatcgggttcctggtgctcatcttcgcctccttcctggtctacctggctgagaaggacgccaactccgacttctcctcctacgccgactcgctctggtgggggacgattacattgacaaccatcggctatggtgacaagacaccgcacacatggctgggcagggtcctggctgctggcttcgccttactgggcatctctttctttgccctgcctgccggcatcctaggctccggctttgccctgaaggtccaggagcagcaccggcagaagcacttcgagaagcggaggatgccggcagccaacctcatccaggctgcctggcgcctgtactccaccgatatgagccgggcctacctgacagccacctggtactactatgacagtatcctcccatccttcagcagccggatgggcatcaaagaccgcatccgcatgggcagctcccagcggcggacgggtccttccaagcagcatctggcacctccaacaatgcccacctccccaagcagcgagcaggtgggtgaggccaccagccccaccaaggtgcaaaagagctggagcttcaatgaccgcacccgcttccgggcatctctgagactcaaaccccgcacctctgctgaggatgccccctcagaggaagtagcagaggagaagagctaccagtgtgagctcacggtggacgacatcatgcctgctgtgaagacagtcatccgctccatcaggattctcaagttcctggtggccaaaaggaaattcaaggagacactgcgaccgtacgacgtgaaggacgtcattgagcagtactcagcaggccacctggacatgctgggccggatcaagagcctgcaaactcgggtggaccaaattgtgggtcgggggcccggggacaggaaggcccgggagaagggcgacaaggggccctccgacgcggaggtggtggatgaaatcagcatgatgggacgcgtggtcaaggtggagaagcaggtgcagtccatcgagcacaagctggacctgctgttgggcttctattcgcgctgcctgcgctctggcacctcggccagcctgggcgccgtgcaagtgccgctgttcgaccccgacatcacctccgactaccacagccctgtggaccacgaggacatctccgtctccgcacagacgctcagcatctcccgctcggtcagcaccaacatggactga

SEQ ID NO: 168250 - DNA, 6688 bp, Homo sapiens
  Payload ID: 13100
  Gene Symbol: KCNQ5
  Gene Name: potassium channel, voltage gated KQT-like subfamily Q, member 5
  Uniprot ID: Q9NR82
  ENST ID: ENST00000342056
  CDS Start-End: 399-3254
ggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtaagttctgtagtaataagcagaagctcttcagaatgtacacctcacggaagcagagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctat

SEQ ID NO: 168251 - DNA, 6566 bp, Homo sapiens
  Payload ID: 13100
  Gene Symbol: KCNQ5
  Gene Name: potassium channel, voltage gated KQT-like subfamily Q, member 5
  ENST ID: ENST00000355194
  CDS Start-End: 348-3146
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 168252 - DNA, 6623 bp, Homo sapiens
  Payload ID: 13100
  Gene Symbol: KCNQ5
  Gene Name: potassium channel, voltage gated KQT-like subfamily Q, member 5
  ENST ID: ENST00000355635
  CDS Start-End: 348-3203
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtaagttctgtagtaataagcagaagctcttcagaatgtacacctcacggaagcagagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 168253 - DNA, 1469 bp, Homo sapiens
  Payload ID: 13100
  Gene Symbol: KCNQ5
  Gene Name: potassium channel, voltage gated KQT-like subfamily Q, member 5
  Uniprot ID: Q9NR82
  ENST ID: ENST00000370392
  CDS Start-End: 85-1368
ctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcaggtttgtgatttctctcttgctacatgtttgtttataaatctgatacctaccaggtgttttaaatgtgtctcatgtgagtaaaatcgatcaacaaatacaagatgattaaaagtgacctttcacaagattgcctgcaaa

SEQ ID NO: 168254 - DNA, 6345 bp, Homo sapiens
  Payload ID: 13100
  Gene Symbol: KCNQ5
  Gene Name: potassium channel, voltage gated KQT-like subfamily Q, member 5
  Uniprot ID: Q9NR82
  ENST ID: ENST00000370398
  CDS Start-End: 110-2908
gggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctataaa

SEQ ID NO: 168255 - DNA, 6539 bp, Homo sapiens
  Payload ID: 13100
  Gene Symbol: KCNQ5
  Gene Name: potassium channel, voltage gated KQT-like subfamily Q, member 5
  ENST ID: ENST00000403813
  CDS Start-End: 348-3119
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaatcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 168256 - DNA, 6596 bp, Homo sapiens
  Payload ID: 13100
  Gene Symbol: KCNQ5
  Gene Name: potassium channel, voltage gated KQT-like subfamily Q, member 5
  ENST ID: ENST00000402622
  CDS Start-End: 348-3176
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaataagttctgtagtaataagcagaagctcttcagaatgtacacctcacggaagcagagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 168257 - DNA, 649 bp, Homo sapiens
  Payload ID: 13100
  Gene Symbol: KCNQ5
  Gene Name: potassium channel, voltage gated KQT-like subfamily Q, member 5
  ENST ID: ENST00000427928
  CDS Start-End: 1-292
gcacacctgcagccctaccaatcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgacaagggccacattaagatcaatgggactgtcattctgatgtatttgtgacgtctgaccagcaaaggtccaagacccagggacaaccaggtgcttgctctgtgaatatcttgaaacacagtaaggaggatgatcatttctggtcaacaatgaaggtgctctttccctctctcacacactccatctaccagcaaatcagagaccactgcttatcttccttagagaggttcctgttgaaagttatttcgaagtcttccaatgataagtaaaattcaagttcttctcccaagaggaattaacctattttatttatcatattatgtagcagacattcacttgccaacacattttattgagtgccacataattttcatgtttataaaataaaatattttatttttcatttaa

SEQ ID NO: 168258 - DNA, 321 bp, Homo sapiens
  Payload ID: 13100
  Gene Symbol: KCNQ5
  Gene Name: potassium channel, voltage gated KQT-like subfamily Q, member 5
  ENST ID: ENST00000441538
  CDS Start-End: 1-273
gagttcgtgatgattgtcgtctttggtttggagttcatcattcgaatctggtctgcgggttgctgttgtcgatatagaggatggcaaggaagactgaggtttgctcgaaagcccttctgtgttataggagtcaggaattgttgcgtaatcttctcagtttcctcccttactcctgttccctatggtgggggcagagtggatttaaggaagaaagtgtatcaccatccatgggcactgttaagaagaatcctttattccatacttctttcatagtatgcacatctcaaaagtctccacttattaaaccagaatttatggaaa

SEQ ID NO: 168259 - DNA, 6236 bp, Homo sapiens
  Payload ID: 13100
  Gene Symbol: KCNQ5
  Gene Name: potassium channel, voltage gated KQT-like subfamily Q, member 5
  ENST ID: ENST00000414165
  CDS Start-End: 348-2816
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 168260 - DNA, 255 bp, Homo sapiens
  Payload ID: 13100
  Gene Symbol: KCNQ5
  Gene Name: potassium channel, voltage gated KQT-like subfamily Q, member 5
  ENST ID: ENST00000443915
  CDS Start-End: 1-207
ctggagttcgtgatgattgtcgtctttggtttggagttcatcattcgaatctggtctgcgggttgctgttgtcgatatagaggatggcaaggaagactgaggtttgctcgaaagcccttctgtgttataggtgaatatcagagtctcagatacctggactatgacaccaacattcttgtcttctatctcctgttttgcaatatttgattaatattaaaagctaacatccatggagtacttatcatggaccgggca

SEQ ID NO: 168261 - DNA, 2830 bp, Homo sapiens
  Payload ID: 13100
  Gene Symbol: KCNQ5
  Gene Name: potassium channel, voltage gated KQT-like subfamily Q, member 5
  Uniprot ID: Q9NR82
  ENST ID: ENST00000629977
  CDS Start-End: 19-2790
ggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaatcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagcca

SEQ ID NO: 168262 - DNA, 3527 bp, Homo sapiens
  Payload ID: 13100
  Gene Symbol: KCNQ5
  Gene Name: potassium channel, voltage gated KQT-like subfamily Q, member 5
  Uniprot ID: Q9NR82
  ENST ID: ENST00000628967
  CDS Start-End: 348-2816
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgact

SEQ ID NO: 168263 - DNA, 2289 bp, Homo sapiens
  Payload ID: 13101
  Gene Symbol: KCNF1
  Gene Name: potassium channel, voltage gated modifier subfamily F, member 1
  Uniprot ID: Q9H3M0
  ENST ID: ENST00000295082
  CDS Start-End: 491-1975
ttgtgtttagaaaaggctcgggcaaagccagcccaagttcgctctctgcacacctcgagcacctcgcggacggcgtgggtccgccagctccgggacctgccgccgctgcctgcgcgccccggggcggaggacggtgccagccgcccacgaggagaccccgctcccgcaggaggccgagctgaagcggcggagcgcgccgccagccagccggggtgagtgccccgggcgaggccggcggccgccaaagcccccgcgggctcgcccgggcgcccggatgccagccccgagccccgccgccgggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacccggctggcggagctcatcaactgcttggctgggggctacgacaccatcttctccctgtgcgacgactacgaccccggcaagcgcgagttctactttgacagggacccggacgccttcaagtgtgtcatcgaggtgtactatttcggggaggtccacatgaagaagggcatctgccccatctgcttcaagaacgagatggacttctggaaggtggacctcaagttcctggacgactgttgcaagagccacctgagcgagaagcgcgaggagctggaggagatcgcgcgccgcgtgcagctcatcctggacgacctgggcgtggacgcagccgagggccgctggcgccgctgccagaagtgcgtctggaagttcctggagaagcccgagtcgtcgtgcccggcgcgggtggtggccgtgctctccttcctgctcatcctcgtctcgtccgtggtcatgtgcatgggcaccatccccgagctgcaggtgctggacgccgagggcaaccgcgtggagcacccgacgctggagaacgtggagacggcgtgcattggctggttcaccctggagtacctgctgcgcctcttctcgtcacccaacaagctgcacttcgcgctgtccttcatgaacattgtggacgtgctggccatcctccccttctacgtgagcctcacgctcacgcacctgggtgcccgcatgatggagctgaccaacgtgcagcaggccgtgcaggcgctgcggatcatgcgcatcgcgcgcatcttcaagctggcccgccactcctcgggcctgcagaccctcacctatgccctcaagcgcagcttcaaggaactggggctgctgctcatgtacctggcagtgggtatcttcgtcttctctgccctgggctacaccatggagcagagccatccagagaccctgtttaagagcatcccccagtccttctggtgggccatcatcaccatgaccaccgtcggctacggcgacatctaccccaagaccacgctgggcaagctcaacgcggccatcagcttcttgtgtggtgtcatcgccatcgccctgcccatccaccccatcatcaacaactttgtcaggtactacaacaagcagcgcgtcctggagaccgcggccaagcacgagctggagctgatggaactcaactccagcagcgggggcgagggcaagaccgggggctcccgcagtgacctggacaacctccctccagagcctgcggggaaggaggcgccgagctgcagcagccggctgaagctctcccacagcgacaccttcatccccctcctgaccgaggagaagcaccacaggacccggctccagagttgcaagtgacaggagggcccctcaggcagagatggaccaggcggtggacagatgggtagatgtggcaggcatgtcatcgacagcacagaagggctgtcctgtgtccccccaaccctcccctggacagactctgaaggccctcccggcacctctgccaaggctgggtaagactcctctatgttgcctgctgtccaggagcccgggagggaggggtgtgcaggagccgcagggccgtgtgggacgagtggaggccgcggcctggctggcacgagagcccacgcccgcttctgtatctccctcaataaagcctcctgctctgtgca

SEQ ID NO: 168264 - DNA, 2211 bp, Homo sapiens
  Payload ID: 13102
  Gene Symbol: KCNG1
  Gene Name: potassium channel, voltage gated modifier subfamily G, member 1
  Uniprot ID: Q9UIX4
  ENST ID: ENST00000371571
  CDS Start-End: 287-1828
gctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgaggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagca

SEQ ID NO: 168265 - DNA, 1096 bp, Homo sapiens
  Payload ID: 13102
  Gene Symbol: KCNG1
  Gene Name: potassium channel, voltage gated modifier subfamily G, member 1
  ENST ID: ENST00000439216
  CDS Start-End: 323-1096
gcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcag

SEQ ID NO: 168266 - DNA, 967 bp, Homo sapiens
  Payload ID: 13102
  Gene Symbol: KCNG1
  Gene Name: potassium channel, voltage gated modifier subfamily G, member 1
  ENST ID: ENST00000424171
  CDS Start-End: 426-967
ggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgagatgaaacagcagagctgaaaagagagatcaccaaggaaagtgcctgaaagggattattcccacgcctccaaaggatcctggcaggctgtgcctgaggagatgggttccaattttagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtgga

SEQ ID NO: 168267 - DNA, 608 bp, Homo sapiens
  Payload ID: 13102
  Gene Symbol: KCNG1
  Gene Name: potassium channel, voltage gated modifier subfamily G, member 1
  ENST ID: ENST00000447736
  CDS Start-End: 465-608
ctgctgccgagacaggatcactttccacacaggaaactcacgtgggggcagggcgtgaaggaaataaatcactaattgggggagttttctgctggagggaaagctgggagggttgaaagaagaaattcctaaaaagaagaggtgattacagccatggggattcacaagagccctccagggcttgtgtgaggcattttccgtttacctccatcaccattcttgccaaacagaatgtcactttttctcttttctgtggtagcaaagatgaaacagcagagctgaaaagagagatcaccaaggaaagtgcctgaaagggattattcccacgcctccaaaggatcctggcaggctgtgcctgaggagatgggttccaattttagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccg

SEQ ID NO: 168268 - DNA, 802 bp, Homo sapiens
  Payload ID: 13102
  Gene Symbol: KCNG1
  Gene Name: potassium channel, voltage gated modifier subfamily G, member 1
  ENST ID: ENST00000433903
  CDS Start-End: 513-802
aggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgaggtgggaactttgcgcgctgcagcctcgccgggcgccaccgaagcgcgaaccggaccccgagcctgcaaactcgggctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaa

SEQ ID NO: 168269 - DNA, 1401 bp, Homo sapiens
  Payload ID: 13103
  Gene Symbol: KCNG2
  Gene Name: potassium channel, voltage gated modifier subfamily G, member 2
  Uniprot ID: Q9UJ96
  ENST ID: ENST00000316249
  CDS Start-End: 1-1401
atggagccatggccctgctccccgggcggcggcggcgggacccgcgcccggcacgtcatcatcaacgtgggcggctgccgcgtgcgcctggcatgggccgcgctggcgcgatgccccctcgcgcgcctggagcgcctgcgcgcctgccgcggccacgacgacctgctgcgcgtgtgtgacgactacgacgtgagccgcgacgagttcttcttcgaccgcagcccgtgcgccttccgcgccatcgtggcgcttttgcgcgcagggaagctgcgactgctgcggggcccgtgcgcgctggccttccgcgacgagctggcctactggggcatcgacgaggcgcgcctggagcgctgctgcctgcgccgcctgcgccgccgcgaggaggaggcggccgaggcccgcgcggggccgacggagcgcggggcgcaggggagcccggcgcgcgccctgggacctcgggggcggctgcagcgcggccggcggcgcctgcgcgacgtggtggacaacccgcactcggggctggcgggcaagctcttcgcctgcgtgtccgtgtccttcgtggccgtcacggccgtgggcctctgcctgagcaccatgccggacatccgcgccgaggaggagcggggcgagtgctcccccaagtgccgcagcctgttcgtgctggagaccgtgtgcgtggcctggttctccttcgagttcctgctgcgctccctgcaggccgagagcaagtgcgccttcctgcgcgcgccactcaacatcattgacatcctggcgctcctgccgttctacgtgtcgctgctgctggggctggcggcaggcccgggcgggaccaagctcctggagcgcgcggggctggtgctgcggctgctgcgtgcgctgcgcgtgctctacgtgatgcgcctggcgcgccactcgctggggctgcgttcgctgggcctgaccatgcgccgctgcgcgcgcgagttcgggctgctgctgctgttcctctgcgtggccatggcgctcttcgcgccactggtgcacctggccgagcgcgagctgggcgcgcgccgcgacttctccagcgtgcccgccagctattggtgggccgtcatctccatgaccaccgtgggctacggcgacatggtcccgcgcagcctgcccgggcaggtggtggcgctcagcagcatcctcagcggcatcctgctcatggccttcccggtcacctccatcttccacaccttttcgcgctcctactccgagctcaaggagcagcagcagcgcgcggccagccccgagccggccctgcaggaggacagcacgcactcggccacagccaccgaggacagctcgcagggccccgacagcgcgggcctggccgacgactccgcggatgcgctgtgggtgcgggcagggcgctga

SEQ ID NO: 168270 - DNA, 3824 bp, Homo sapiens
  Payload ID: 13104
  Gene Symbol: KCNG3
  Gene Name: potassium channel, voltage gated modifier subfamily G, member 3
  Uniprot ID: Q8TAE7
  ENST ID: ENST00000306078
  CDS Start-End: 597-1907
gcggcgcggagggaggtgagcggcgcgcgcggagccggcgggcgaggaggaggactgcacagaggccccgcccccgccgccgcgagccggctcttcgccgcctccgaacccgctcactttgcctctcgcctctggacggcggcggggcggccgccggattcgcggccgcagggagcgccggagacggggagctattccgccccggcggctccattcggcgcccgcagccctcagggggtcggccccgcggcttgggagagggcaccgcggcctcggtgtgcgcagccctcgggcgcgagggtcggcggcgcggacacagccgcgttcccagccggtggggctcagcgctggcgccggcgaggactccccggccacccgcaggtaccgccgggcggagggcgcgctactagcagcgccggagatactcgagcccagggacccccgggccagcggagggcaggagcggagccccgagggagcgcgggccccgacggcgcgctcccccgtcagccacgggcaggcaggccccgcgtggcggcttggggtggggggctgcagcggggccctcgggccgaaagtcccccgggcggccagccatgaccttcgggcgcagcggggcggcctcggtggtgctgaacgtgggcggcgcccggtattcgctgtcccgggagctgctgaaggacttcccgctgcgccgcgtgagccggctgcacggctgccgctccgagcgcgacgtgctcgaggtgtgcgacgactacgaccgcgagcgcaacgagtacttcttcgaccggcactcggaggccttcggcttcatcctgctctacgtgcgcggccacggcaagctgcgcttcgcgccgcggatgtgcgagctctccttctacaacgagatgatctactggggcctggagggcgcgcacctcgagtactgctgccagcgccgcctcgacgaccgcatgtccgacacctacaccttctactcggccgacgagccgggcgtgctgggccgcgacgaggcgcgccccggcggggccgaggcggctccctccaggcgctggctggagcgcatgcggcggaccttcgaggagcccacgtcgtcgctggccgcgcagatcctggctagcgtgtcggtggtgttcgtgatcgtgtccatggtggtgctgtgcgccagcacgttgcccgactggcgcaacgcagccgccgacaaccgcagcctggatgaccggagcaggtactccgccggccctgggagggagccctccgggataattgaagctatctgcataggttggttcactgccgagtgcatcgtgaggttcattgtctccaaaaacaagtgtgagtttgtcaagagacccctgaacatcattgatttactggcaatcacgccgtattacatctctgtgttgatgacagtgtttacaggcgagaactctcaactccagagggctggagtcaccttgagggtacttagaatgatgaggattttttgggtgattaagcttgcccgtcacttcattggtcttcagacactcggtttgactctcaaacgttgctaccgagagatggttatgttacttgtcttcatttgtgttgccatggcaatctttagtgcactttctcagcttcttgaacatgggctggacctggaaacatccaacaaggactttaccagcattcctgctgcctgctggtgggtgattatctctatgactacagttggctatggagatatgtatcctatcacagtgcctggaagaattcttggaggagtttgtgttgtcagtggaattgttctattggcattacctatcacttttatctaccatagctttgtgcagtgttatcatgagctcaagtttagatctgctaggtatagtaggagcctctccactgaattcctgaattaatgcattgcaaatcaattcttgcatacacttcatagaaagactttgatgctgcttcatatttatgtgtttcttgctgggtgagcactgcagtggcattgtcatcatcttggtagggtaaaaattatccttcccagccgaagggataaaacagtttacttgttatggagtaaatagaattgagactgcaaaggaagaataatgactcctagagtaaactttaggacccggttttatttagacttgttttcccgtttccttgaatgattacacatttttaaaaaatacattatttgaacattttaaaacagaaaggtactattttccaaatgtttttccatcttatgaattcagaagaagcttggaacttatagtgttttttgtttgagagtaacattttcatttctaaatgttttataatttctcatatcaatgtcagaagtatcctggaaacatatgtcacatgcgggaactgtttaacaaatactttaaaaatttggccaaaatttaaactgtataatggagctagatacaagcaagaatagtatttgaaagacttttccagcatacttctcaattctttgctttatttttgtgccaattattcaccttatcgtgccgcttcatggaagcttgagtatgttctcccttttccattttggatttatctctttactgtaatgactcaaaaggtatttaagaattgacgagagcttgtgttgtttagcatcttactggataatatttgaattcattgctgttcctaggtgataactgtcctaatatttagatgtccaaacaagaatacttccaacataaaaattataataggaataatttgagatgactcaatattacaacctcttcttctcttaacctcctcccccaaacactagaggtttaataagacttatcagatgaaaggatatttatatagccttttagtagcaaagtcatacttacgtgttgtcactggattatcataaaagggagaaattaaatattactgtactcttagttgctgtgtagctaagtcaattttaagccagtaaaagcgatggatacataatgatttgatctgatctttaactattgtgaatcacagctacaccaaaactcttcttgtaagaatactgactaatatgccatgttaatctggctagattattaggactagataatgtaaaagtgatgattgtttagtaactaaattttagcaacagaaattagaattttgctttttcaaccagttaccataaagaagttagtgtatatataaacacaaataattagtgacagattcataaaaaattgaatgttgtacacagtaattttgtcagaggtagagaagacagggattgggaagtggtgggtgatggaggacctggatatatttatcaaataaagggttaccagaagtgttcattaaaggaattttagccatcatctagttcaaacctcaactattacaggtagaaaatcagggcaggagagaatataattgtgaaggagtcagggctaacacctggatctccagaaacctagcccagcaggttaatcttcacacatctctgggttctgagaaaagcctggaaaaatcacacttctttgtcattgtcatgctgaggtaataatagcaaaactgttttctttcccttaatttcctttcctaagcttatgtaatagtttggccattaaatatcttgccctattttccctattactgctagtatgctacttcttacatacccaaaagaaattcagttatttattgtatatttattgtattctaatataattgaaataaatggcatggatttattttttcttaactatttggattaaagctttgtggttcatgcaaacaatgtgcagatgatagcacctccatattactaataaaaatatgataaccatcaa

SEQ ID NO: 168271 - DNA, 3656 bp, Homo sapiens
  Payload ID: 13104
  Gene Symbol: KCNG3
  Gene Name: potassium channel, voltage gated modifier subfamily G, member 3
  Uniprot ID: Q8TAE7
  ENST ID: ENST00000394973
  CDS Start-End: 477-1754
gcctctcgcctctggacggcggcggggcggccgccggattcgcggccgcagggagcgccggagacggggagctattccgccccggcggctccattcggcgcccgcagccctcagggggtcggccccgcggcttgggagagggcaccgcggcctcggtgtgcgcagccctcgggcgcgagggtcggcggcgcggacacagccgcgttcccagccggtggggctcagcgctggcgccggcgaggactccccggccacccgcaggtaccgccgggcggagggcgcgctactagcagcgccggagatactcgagcccagggacccccgggccagcggagggcaggagcggagccccgagggagcgcgggccccgacggcgcgctcccccgtcagccacgggcaggcaggccccgcgtggcggcttggggtggggggctgcagcggggccctcgggccgaaagtcccccgggcggccagccatgaccttcgggcgcagcggggcggcctcggtggtgctgaacgtgggcggcgcccggtattcgctgtcccgggagctgctgaaggacttcccgctgcgccgcgtgagccggctgcacggctgccgctccgagcgcgacgtgctcgaggtgtgcgacgactacgaccgcgagcgcaacgagtacttcttcgaccggcactcggaggccttcggcttcatcctgctctacgtgcgcggccacggcaagctgcgcttcgcgccgcggatgtgcgagctctccttctacaacgagatgatctactggggcctggagggcgcgcacctcgagtactgctgccagcgccgcctcgacgaccgcatgtccgacacctacaccttctactcggccgacgagccgggcgtgctgggccgcgacgaggcgcgccccggcggggccgaggcggctccctccaggcgctggctggagcgcatgcggcggaccttcgaggagcccacgtcgtcgctggccgcgcagatcctggctagcgtgtcggtggtgttcgtgatcgtgtccatggtggtgctgtgcgccagcacgttgcccgactggcgcaacgcagccgccgacaaccgcagcctggatgaccggagcaggataattgaagctatctgcataggttggttcactgccgagtgcatcgtgaggttcattgtctccaaaaacaagtgtgagtttgtcaagagacccctgaacatcattgatttactggcaatcacgccgtattacatctctgtgttgatgacagtgtttacaggcgagaactctcaactccagagggctggagtcaccttgagggtacttagaatgatgaggattttttgggtgattaagcttgcccgtcacttcattggtcttcagacactcggtttgactctcaaacgttgctaccgagagatggttatgttacttgtcttcatttgtgttgccatggcaatctttagtgcactttctcagcttcttgaacatgggctggacctggaaacatccaacaaggactttaccagcattcctgctgcctgctggtgggtgattatctctatgactacagttggctatggagatatgtatcctatcacagtgcctggaagaattcttggaggagtttgtgttgtcagtggaattgttctattggcattacctatcacttttatctaccatagctttgtgcagtgttatcatgagctcaagtttagatctgctaggtatagtaggagcctctccactgaattcctgaattaatgcattgcaaatcaattcttgcatacacttcatagaaagactttgatgctgcttcatatttatgtgtttcttgctgggtgagcactgcagtggcattgtcatcatcttggtagggtaaaaattatccttcccagccgaagggataaaacagtttacttgttatggagtaaatagaattgagactgcaaaggaagaataatgactcctagagtaaactttaggacccggttttatttagacttgttttcccgtttccttgaatgattacacatttttaaaaaatacattatttgaacattttaaaacagaaaggtactattttccaaatgtttttccatcttatgaattcagaagaagcttggaacttatagtgttttttgtttgagagtaacattttcatttctaaatgttttataatttctcatatcaatgtcagaagtatcctggaaacatatgtcacatgcgggaactgtttaacaaatactttaaaaatttggccaaaatttaaactgtataatggagctagatacaagcaagaatagtatttgaaagacttttccagcatacttctcaattctttgctttatttttgtgccaattattcaccttatcgtgccgcttcatggaagcttgagtatgttctcccttttccattttggatttatctctttactgtaatgactcaaaaggtatttaagaattgacgagagcttgtgttgtttagcatcttactggataatatttgaattcattgctgttcctaggtgataactgtcctaatatttagatgtccaaacaagaatacttccaacataaaaattataataggaataatttgagatgactcaatattacaacctcttcttctcttaacctcctcccccaaacactagaggtttaataagacttatcagatgaaaggatatttatatagccttttagtagcaaagtcatacttacgtgttgtcactggattatcataaaagggagaaattaaatattactgtactcttagttgctgtgtagctaagtcaattttaagccagtaaaagcgatggatacataatgatttgatctgatctttaactattgtgaatcacagctacaccaaaactcttcttgtaagaatactgactaatatgccatgttaatctggctagattattaggactagataatgtaaaagtgatgattgtttagtaactaaattttagcaacagaaattagaattttgctttttcaaccagttaccataaagaagttagtgtatatataaacacaaataattagtgacagattcataaaaaattgaatgttgtacacagtaattttgtcagaggtagagaagacagggattgggaagtggtgggtgatggaggacctggatatatttatcaaataaagggttaccagaagtgttcattaaaggaattttagccatcatctagttcaaacctcaactattacaggtagaaaatcagggcaggagagaatataattgtgaaggagtcagggctaacacctggatctccagaaacctagcccagcaggttaatcttcacacatctctgggttctgagaaaagcctggaaaaatcacacttctttgtcattgtcatgctgaggtaataatagcaaaactgttttctttcccttaatttcctttcctaagcttatgtaatagtttggccattaaatatcttgccctattttccctattactgctagtatgctacttcttacatacccaaaagaaattcagttatttattgtatatttattgtattctaatataattgaaataaatggcatggatttattttttcttaactatttggattaaagctttgtggttcatgcaaacaatgtgcagatgatagcacctccatattactaataaaaa

SEQ ID NO: 168272 - DNA, 5179 bp, Homo sapiens
  Payload ID: 13105
  Gene Symbol: KCNG4
  Gene Name: potassium channel, voltage gated modifier subfamily G, member 4
  Uniprot ID: Q8TDN1
  ENST ID: ENST00000308251
  CDS Start-End: 70-1629
gctggaaactggctccctgagacaagaagactggtaaacccagcgcttcctacctggtggtcttcagcaatgcccatgccttccagagacgggggcctgcatcccagacaccaccactatggttcccacagcccttggagtcagctcctgtccagccccatggagacgccgtccatcaagggcctttactaccggagggtgcggaaggtgggtgccctggacgcctccccagtggacctgaagaaggagatcctgatcaacgtggggggcaggaggtatctcctcccctggagcacactggaccggttcccgctgagccgcctgagcaaactcaggctctgtcggagctacgaggagatcgtgcagctctgcgatgattacgacgaggacagccaggagttcttcttcgacaggagccccagcgccttcggggtgatcgtgagcttcctggcggccgggaagctggtgcttctgcaggagatgtgcgcgctgtccttccaggaggagctggcctactggggcatcgaggaggcccacctggagaggtgctgcctgcggaagctgctgaggaagctggaggagctggaggagctggccaagctgcacagggaggacgtactgaggcagcagagggagacccgccgccccgcctcgcactcctcgcgctggggcctgtgcatgaaccggctgcgcgagatggtggaaaacccgcagtccgggctgcccgggaaggtcttcgcttgcctctccatcctcttcgtggccaccacagccgtcagcctgtgtgtcagcaccatgcccgacctcagggcagaggaggaccagggcgaatgctctcggaagtgctactatattttcatcgtggagaccatctgcgtggcctggttctccctggagttctgcctgcggtttgtccaggcccaagacaagtgtcagttcttccaggggcccctgaacatcatcgacatcctggccatctccccatactacgtgtcgctggcggtgtctgaggagcccccggaggacggcgagaggccgagcgggagctcctacctggagaaggtggggctggtcctgcgtgtgctgcgagcgctgcgcatcctctacgtgatgcgcctggctcgccactcgctggggctgcagacgctggggctcaccgtgcgccgttgcacacgtgagttcggcctgctccttctcttcctggccgtggccatcaccctcttctcccctttggtctacgtggccgagaaggagtccgggcgggtgctggagttcaccagcatccccgcctcctattggtgggccatcatctccatgacaacggtgggctacggggacatggtgccccgcagtgtgccaggccagatggtggccctcagcagcatcctgagcgggatcctcatcatggccttcccggccacgtctatcttccacaccttctcccactcctacctggagctcaagaaggagcaggagcagcttcaggcccgcctccgccacctccaaaacaccggtccagccagtgaatgtgaactcctggacccccatgtggccagtgaacatgagctcatgaacgatgtcaatgacctaatcctggagggcccagccttgcctatcatgcacatgtaactcagcaccccccatgactacatggtaacctcaacccatcaccctgcctgaaacacactcaagggtaccccgcatagaccacctggtggtgtttctagagcccagggaagactttcaaagctggaggggcataaggccacagaggctgtgtgtctgtgatccttgtccctcggggccccgatgtcccaggctgactgtgtccagcctgcttgccttttcctctctctgcccatctactgagcatgtccaatcttgctggagtagctcagtctcctttcattctcttttccttcccagcagaggctttaacatcccaggctgggttctggatgcccatagaactggtaaccattggtatttgcatactgagcctatgtaatttcatgatttccctaagaccctccttcctgggccatgccaccactggaaatcaaaggtccagtcactgcaaacccctctaatcagatctccccacccaacctttccacgggttccagagggatcaatatgttctccttctgctcaccaccaccagtgatatttccctaatgctgctacctcccgccagctctgaacacttgtagctaagaaggcagaatcagcctttttgcagtaaatctcatgttgaggctgatgcccccaagcctgccatcctttacctggagctcaagaaggagcaggcatccccaggcatgcctgggatctgtgacctgggacctgggacctgggacctgggcagaaactccactttccagcacagccaggccctccctggccgcctggactcttggtgtggtgttctccagttatccagtccttagccttgacagagacaaactctttcagggtccatgttgtcccttgagaggatcgttcctgctgctggttgctcccacactgcaggggccttagcttttcatccacagctgagcccccatggactcaatgtagctttggcacagaaacaaggggaattgtaggtgctgtcccttgctggcttcccagactagtcatctccatgctggaggatagacattcttagctcacatttcaatgtattcatttctgcattcatctgtgaacagagtctgtcctttgcatccaggggaggaggcagatggaggtctgagtcactggagataaaccagcatattctgagagcaggcaggaaggagcaatgacttccaagcagtgggctcccaaaggcctcacagagacatgggcagggctggagagtagaggtgtattttaggagatgaagctgaacagctgggttgggttgagaaggcgtgggccttgaatgctttatggagggcagagtgatgtgcacaggctgtgggttagggagatgatgaggctggattgggcatgagaagcccagtttgggatgaggagccattgagccattcaggcaagacagccctccctccttcacgggcttaatcctgcaagattctgtcaaatcctggcttctcccagcaggacacaccttggagacatcctgatggcacttccccagagtggcatggcccacataggagtttgctgttggctctaggactcttgaagaaagtgcacaagatcaaaacaggtgacagtgaagtggtttcggccctgccaatctgatatcgtgtacgtatgagagtggtcagcattttaccactggtaacaagttccttgctgttcattcattctgctagttttttgcgatttcccgctgtgtgccaggcatagtcctccactgatggcaatgccagacagcagcgtggcagagggctctggcccaggaagcaccctgcaccagcacctagcgtccagggagccttggcctcctggcgagcctgcctttccttggagtcctccaggtgtccccccaactatacaggcacatgtccccattcttttagaccccaatctttcccaagctgacatgtcaccaggtgacatagtggttcagtggccatgacacaaggaaagccccttcaccctataaaatccccagcctggatggccactccactccacaaagtgacaggcagattcccataagcgttgcgtagaaattccatgtcacaggcaccttggacagtagccatagaagtgtttctgttccagagtaacattttatttattacttatttatttatttatttattgacagagtctctctctgtccgccaggctggagtgcagtggcttgatcccagctcactgcaacctccgcctcctgggttcaagcaattctcctgcctcagcctcccaaatagcggggattacaggcacccaccacctgtaatcccagctatttggagatcaaatgctcagctaatttgatatttttagtagagacaaggtttcaccatgtggacaggctggtcttgaactcctgatgtcaggtgatccgcctgcctcggcctcccaaagtgctggaattacaggcacgagccaccgcacccggcccagactaacattttttttttttttttttttgagacagagtctccctctgtcacccaggctggagtgcagtggctcaatctcggctcactgcaagctccgcctcccaggttcacgccattctcctgcctcagcctcctgagtagctgtgactacaggtgccaccaccacgcctggataattttttgtatttttaggagagacggggtttcaccatgttagccaggatggtctccatctcctgacctcgtgatccgcccgcctcggcctcccaaagtgctgggattacaggcgtgagccaccgtgcccaagcctgactaacattttaataactacgcttaggcaaaatagtaaaaggacaaagtctcccacttactctctttctggggactgactggcttgggcgctggctgaaacccagtgtcttcactccctgtgtgacctcgggcaggccccttccccctcagttagctgcaggcaggtgttggactagatctgtggttttctgacctgggttccacaaagcaagctcagggactgtcctgcggatgaagaagaccagcagcaaagcaggcagagctctgcctcctggggcaaaacatttgcaattaatgacactgaaaagaatgtgcaaatccccagtctcctctccttcccgtcagtgtccagcccagccctttgaactgagtggtaagctcattctggaaccagagacaaagcctaaacagccactggaaggtctgggacccacatcagcccccacatctgccctgccttctcatcgaagacatattttgtgcgcatgcctggtgaaaacttcttaatgacagctctgcccatccctgtaactggcttctacccaggcatatcccttctcctctgcttcacctaccagacctcttcaccaaagtgtgccagcactaaaagaaacatttaaaatcaaaattaggtgaagcaccaccaccattatgagattctatagtgtcttaatgttcacccagttgagattctctgctaaattagacatggaaaattggaattgattgctcgcatgtggggcttaattaaacgctctattttttctccctggtaa

SEQ ID NO: 168273 - DNA, 2199 bp, Homo sapiens
  Payload ID: 13105
  Gene Symbol: KCNG4
  Gene Name: potassium channel, voltage gated modifier subfamily G, member 4
  Uniprot ID: Q8TDN1
  ENST ID: ENST00000568181
  CDS Start-End: 122-892
gtcccttccctgggcaccaagagatgggctccccttgcctggcagagaaacagctggaaactggctccctgagacaagaagactggtaaacccagcgcttcctacctggtggtcttcagcaatgcccatgccttccagagacgggggcctgcatcccagacaccaccactatggttcccacagcccttggagtcagctcctgtccagccccatggagacgccgtccatcaagggcctttactaccggagggtgcggaaggtgggtgccctggacgcctccccagtggacctgaagaaggagatcctgatcaacgtggggggcaggaggtatctcctcccctggagcacactggaccggttcccgctgagccgcctgagcaaactcaggctctgtcggagctacgaggagatcgtgcagctctgcgatgattacgacgaggacagccaggagttcttcttcgacaggagccccagcgccttcggggtgatcgtgagcttcctggcggccgggaagctggtgcttctgcaggagatgtgcgcgctgtccttccaggaggagctggcctactggggcatcgaggaggcccacctggagaggtgctgcctgcggaagctgctgaggaagctggaggagctggaggagctggccaagctgcacagggaggacgtactgaggcagcagagggagacccgccgccccgcctcgcactcctcgcgctggggcctgtgcatgaaccggctgcgcgagatggtggaaaacccgcagtccgggctgcccgggaaggtcttcgcttgcctctccatcctcttcgtggccaccacagccgtcagcctgtgtgtcagcaccatgcccgacctcagggcagaggaggaccaggtgagcggcctctgatggcattcacggctccatcccgcagggtgcctgggcggagatgtcttttaggggcccaagaaaatgtcttcagatcttaaaataagaagaaaaaaatgaatattatccaacatgggttatattcattattaggccatcagtcataaaagataattttccatcttttttttttttattggagtcctgcaaaggcaaaagtgcctaaggctcaccgtgaaaatcattacgtggccctcagccatgcgtggactcagtgggccacacagacacagtgtcacctctcccagctctcccgagtctgtgactacaggcaaatcacgccacctcctctctgagcctgtctcccactccgtgaaatgggtaacatcacctcgaaggtttactcacccagtgaactcaacatgtgtttactgaacaccactctgtgctaagccctagagcaggtcaaaaacataaaatccctgccttcttgagctaacattctcctgggcatccccactccattttcagatgaggaaactgaggcatgggccatttattttcctcggagctccacagtaaggatgccaatgatgcaaaggtccccggcctcagtttccctgcagtgctcagtgtctgggccagtctcactggatgggaaactcacagatgagctgatctgtaagtcactctgccccaggaggccagagtaaaaagtgctgcttgcccacaccttcgtcccctttgcagggagttacaggagaccccgagacaccctccctccactcgggagccagatggtctgagaagtgaaataagaacctagcatttggttgagagggttattggaaagcttcaaacagagaattagattgtttcctgatttaaaaaatcactcctctccagcaccgagctcccccagggctgcccatcatcttaatgtttggagcttgccttgtaatcaacagagagagaaactaaacacatacgtaagatggtgcttgctctatttggctcctaacagttgccagcccacctaagttctcttcgcttaaagatatgtcccagggcaagacaacaggatcagagaacttgccagatagaaaagacttaaatggagaaccagcccatgcctcacagacagtaggatcccagtaaatatgggttgaataaaatgtgtcttgtccaacctacaaaagtttggccctaaaaaaacccacaaaatatttggacctttaaacagcttgttttcccatggagaagatgacaatgccaatcataggcattttttcattctacagcataaaaacatgagatttaagagcctg

SEQ ID NO: 168274 - DNA, 2927 bp, Homo sapiens
  Payload ID: 13106
  Gene Symbol: KCNV1
  Gene Name: potassium channel, voltage gated modifier subfamily V, member 1
  Uniprot ID: Q6PIU1
  ENST ID: ENST00000297404
  CDS Start-End: 343-1845
ggtgacaacgtttgggaagggccagggcgaccggcagtgtgcacagggactgtgtcgggcttggacctcacctgatcctctctcttagcgcgacccttcctctgctccctgtctcctctttctgccacttgtgcgctgcttccgcgcactcccggctccctagcggcaggaggaggaaggcgcacagcgggtggagagggtgcgccaaggagaggtaaccccttcgggagcccggggaatcccggccgccaccaggggccgtgccaccgccctcgcgggaccaaagcttccggcgtgtccccaactttgtggcgccctcaggccgcggcgactgggttagagatgccttccagcggcagagcgctgctggactcgccgctggacagcggctccctgacctccctggactctagtgtcttctgcagcgagggtgaaggggagcccttggcgctcggggactgcttcacggtcaacgtgggcggcagccgcttcgtgctctcgcagcaggcgctgtcctgcttcccgcacacgcgccttggcaagctggccgtggtggtggcttcctaccgccgccccggggccctggccgccgtgcccagccctctggagctttgcgacgatgccaaccccgtggacaacgagtacttcttcgaccgcagctcgcaggcgttccgatatgtcctgcactactaccgcaccggccgcctgcatgtcatggagcagctgtgcgcgctctccttcctgcaggagatccagtactggggcatcgatgagctcagcatcgattcctgctgcagggacagatacttcagaaggaaagagctgagtgaaactttagacttcaagaaggacacagaagaccaggaaagtcaacatgagagtgaacaggacttctcccaaggaccttgtcccactgttcgccagaagctctggaatatcctggagaaacctggatcttccacagctgcccgtatctttggcgtcatctccattatcttcgtggtggtgtccatcattaacatggccctgatgtcagctgagttaagctggctggacctgcagctgctggaaatcctggagtatgtgtgcattagctggttcaccggggagtttgtcctccgcttcctgtgtgtgcgggacaggtgtcgcttcctaagaaaggtgccaaacatcatagacctccttgccatcttgcccttctacatcactcttctggtagagagcctaagtgggagccagaccacgcaggagctggagaacgtggggcgcattgtccaggtgttgaggctgctcagggctctgcgcatgctaaagctgggcagacattccacaggattacgctcccttgggatgacaatcacccagtgttacgaagaagtcggcctactgctcctatttctatccgtgggaatctctatattttcaactgtagaatactttgctgagcaaagcattcctgacacaaccttcacaagtgtcccttgtgcatggtggtgggccaccacctctatgactactgtgggatatggggacattagaccagacaccaccacaggcaaaatcgtggccttcatgtgtatattatcgggaattcttgtcttggccttgcctattgctattattaacgatcgcttctctgcttgctacttcaccttgaaactcaaggaagcagctgttagacagcgtgaagccctaaagaagcttaccaagaatatagccactgactcatatatcagtgttaacttgagagatgtctatgcccggagtatcatggagatgctgcgactgaaaggcagagaaagagcaagtactaggagcagcgggggagatgatttctggttttgaattaattttcaatttatttacaaaagctatgtacaattaactaaaatgataaagcagtgatgtggatttctgtattctgatgatgagtctcttcagagtactgctcatcttaattaatttttgctgatatattgcttcatctactagaatatttcacatcacctataacaactgcacagtgttctgacacatttgagtgtccaaaatagccaattaacacaaccaaatacaactgggccaatataaacatgtttgaattgtcaaatataaaataatgttattgcaatacatacaaaaaagttaaagattttatgtatcactaacattagaagttttttgcaccactaattttttaaaaatggaaggtaaactgcatagcccagagaaagataagtaaatatttaagaacatattgaacaactttgctatttaaagatattatccaagtacataaattactccgttctctatcagttaaagctattgaatataatacttagctttacaagagaaaacccatatttgatgggcagagattatatccctatcttctttttcatgtaaaccactggtcacaaatgaactgatctctgtatcccattattactataagaggtgggaatcccaaaactgcttagattgcagtacatgagtctacacaaagacttcaacaattgcacatcttcattctcccaactgagtgtagtatgtggagcataaaacagcatatttcttagtatttcatgaatatcagatggtctttaaatgtctctttatggatgtattgttcacattatggctttaaaataatgaatatgtaaaagtgaggtagtgaacatcctaaatttctacactggaattactaaataatcttatttcataaaatgggaaatatatgttaaatgacatcactggatgaacttgaagatcttttacttgttaacaaaaaaatactatggacagctttctgattgttggggtaaatagcaaatgttcaaactttgcaggcattttgacattcatcataacaacacaattcctagacattgtattatataattaaagccaaaacctctaaagct

SEQ ID NO: 168275 - DNA, 6979 bp, Homo sapiens
  Payload ID: 13106
  Gene Symbol: KCNV1
  Gene Name: potassium channel, voltage gated modifier subfamily V, member 1
  Uniprot ID: Q6PIU1
  ENST ID: ENST00000524391
  CDS Start-End: 1034-2536
agagcgggcggggcggacacgcttagcgtaagcgcaggggccaggagcccggagggaggtggaggcggggcaaggcaaggcagcaggcgctgggtagagctcagctggaacacagtttccctcctggaccggtcgagtcagacctcacgtgtagactaagaggatcaaaagaagagtacgttacctgcggcgccggttgtgcgcagaccagatgtgccgggagctgcaggaggtcagaacctaagggagacggcggaagaaaatggagcgtcagtgatcatcagactagaatgagagtgaattgggagaaaatggtgcggccccctcacccagagaaccctcccccacctgctcacacccccagcgaacaccccgggggaggcctatgaagcagcagtaaaagaaaagggaggaatataaattctcaagttggaagggacccggttaccacttcctttgctttctgaactttttgttttggtctcctgcgggcaggagtgagtctcgccatcccccttgcttgcttgcttgcttgcgttcagctaagagtcatcttctctcctcttcctcctcctccgccccacatctccctccttcctcccttccccaacccctccacccaccaagtagcgagtcattcaatctgtacacctcctgggctgggaatcgcaattgcgaagttgggaggcggggtgacaacgtttgggaagggccagggcgaccggcagtgtgcacagggactgtgtcgggcttggacctcacctgatcctctctcttagcgcgacccttcctctgctccctgtctcctctttctgccacttgtgcgctgcttccgcgcactcccggctccctagcggcaggaggaggaaggcgcacagcgggtggagagggtgcgccaaggagaggtaaccccttcgggagcccggggaatcccggccgccaccaggggccgtgccaccgccctcgcgggaccaaagcttccggcgtgtccccaactttgtggcgccctcaggccgcggcgactgggttagagatgccttccagcggcagagcgctgctggactcgccgctggacagcggctccctgacctccctggactctagtgtcttctgcagcgagggtgaaggggagcccttggcgctcggggactgcttcacggtcaacgtgggcggcagccgcttcgtgctctcgcagcaggcgctgtcctgcttcccgcacacgcgccttggcaagctggccgtggtggtggcttcctaccgccgccccggggccctggccgccgtgcccagccctctggagctttgcgacgatgccaaccccgtggacaacgagtacttcttcgaccgcagctcgcaggcgttccgatatgtcctgcactactaccgcaccggccgcctgcatgtcatggagcagctgtgcgcgctctccttcctgcaggagatccagtactggggcatcgatgagctcagcatcgattcctgctgcagggacagatacttcagaaggaaagagctgagtgaaactttagacttcaagaaggacacagaagaccaggaaagtcaacatgagagtgaacaggacttctcccaaggaccttgtcccactgttcgccagaagctctggaatatcctggagaaacctggatcttccacagctgcccgtatctttggcgtcatctccattatcttcgtggtggtgtccatcattaacatggccctgatgtcagctgagttaagctggctggacctgcagctgctggaaatcctggagtatgtgtgcattagctggttcaccggggagtttgtcctccgcttcctgtgtgtgcgggacaggtgtcgcttcctaagaaaggtgccaaacatcatagacctccttgccatcttgcccttctacatcactcttctggtagagagcctaagtgggagccagaccacgcaggagctggagaacgtggggcgcattgtccaggtgttgaggctgctcagggctctgcgcatgctaaagctgggcagacattccacaggattacgctcccttgggatgacaatcacccagtgttacgaagaagtcggcctactgctcctatttctatccgtgggaatctctatattttcaactgtagaatactttgctgagcaaagcattcctgacacaaccttcacaagtgtcccttgtgcatggtggtgggccaccacctctatgactactgtgggatatggggacattagaccagacaccaccacaggcaaaatcgtggccttcatgtgtatattatcgggaattcttgtcttggccttgcctattgctattattaacgatcgcttctctgcttgctacttcaccttgaaactcaaggaagcagctgttagacagcgtgaagccctaaagaagcttaccaagaatatagccactgactcatatatcagtgttaacttgagagatgtctatgcccggagtatcatggagatgctgcgactgaaaggcagagaaagagcaagtactaggagcagcgggggagatgatttctggttttgaattaattttcaatttatttacaaaagctatgtacaattaactaaaatgataaagcagtgatgtggatttctgtattctgatgatgagtctcttcagagtactgctcatcttaattaatttttgctgatatattgcttcatctactagaatatttcacatcacctataacaactgcacagtgttctgacacatttgagtgtccaaaatagccaattaacacaaccaaatacaactgggccaatataaacatgtttgaattgtcaaatataaaataatgttattgcaatacatacaaaaaagttaaagattttatgtatcactaacattagaagttttttgcaccactaattttttaaaaatggaaggtaaactgcatagcccagagaaagataagtaaatatttaagaacatattgaacaactttgctatttaaagatattatccaagtacataaattactccgttctctatcagttaaagctattgaatataatacttagctttacaagagaaaacccatatttgatgggcagagattatatccctatcttctttttcatgtaaaccactggtcacaaatgaactgatctctgtatcccattattactataagaggtgggaatcccaaaactgcttagattgcagtacatgagtctacacaaagacttcaacaattgcacatcttcattctcccaactgagtgtagtatgtggagcataaaacagcatatttcttagtatttcatgaatatcagatggtctttaaatgtctctttatggatgtattgttcacattatggctttaaaataatgaatatgtaaaagtgaggtagtgaacatcctaaatttctacactggaattactaaataatcttatttcataaaatgggaaatatatgttaaatgacatcactggatgaacttgaagatcttttacttgttaacaaaaaaatactatggacagctttctgattgttggggtaaatagcaaatgttcaaactttgcaggcattttgacattcatcataacaacacaattcctagacattgtattatataattaaagccaaaacctctaaagctaagaactagctcatgattcccattattttagtaaatgagattctacaacctaagaataacaaggaatgcatcactttaatacctacatttccaatataatagagcccccaaggggaagaaaattggttcttgaggaaaaaaaaatcttatcacttcatttacaaaacacagataagcatattgagtatatctgtggtattaacatttcatgggggtgagatgttagggaaaaaagcctagaaggctctttgccaggggtgaatggtgataagaaataaacattgaggactgctttaatatatagctataaggtatttcataaactctatttaagacatcatattatgctatgcactaccaagaaagaaagatgccagtcaattgtaagatgccattaactgtaaaatgcatccggatttcagatatgtaaaaatttaaaataagcaccttaaaatcaatgaaatatcgcatgtactacctcctgttttctggtatgcatggttaagctctgaaaacattttcactgatggcatgagttttagattgtgtgctaaagtactttaattcatttaacttgtttccacttctcctaaatattataaaaggttcaggagatatgaatattagtaagataaatattttacttcttacacacatacatgggtgctagattgtggcacagggccactagtcatagtataaatcccttccacaatctgaagggaaagtagaagttagacacagaaggtaaacttactccagcttttctagaactttccctaataagaatagttactctgatccaggactatgctctgtattcatcatgtattatgccattttatcctcaaaatatccctattatataattactattcttatactcttcaaaatacatattttatatatttattaactcaacaaatatttattaaggatctttggtgttctggggactagggagtctttcttaaacaagactaggtcctgttttcttgtagttaatattctgttcaaaggtgtgtgaggaaaagacagcgaaactgaaacattaaaaggtataaacttgcctaaattcacacaggctatagatggcagagccagcgctgaataccaatctgcctgacccggaaaacgacactcctaaaagtcaaattgcagatttcattcttcctacacaagctctgcatagaaatttattttttaggcaggcaagccaacttcttgtgcatggagaagttcaatatgccttaagtaaaatatcagcttattctcagaggtggaatggtgcttttaagaaaaggctgtggtgacaccttatagtcattattagattaaaaatatattatctttagagtaaatagtagttggaaataaaaaaaattaaaaactatgtgtatacatatgtatatatgtttttatcatggaggatcctaaacatcttctctacaaatgtgctgttagctatataaatgttgtcaagatgtaggtcttcagaaagaagttttaaaatatcattgcttactcaattttgctgttaaataaaatatcattttatttattcaatgaatgtatatataagcaaaccaaatttcatttaggtaaaaaaatcaaggcaggaactctgccaattttataacccattattttaaaacagtaaacactttttaaacatctaagaattattgttataaaacaatatttaattttttaaaatataaaataattgaattattgtctttctctaagctatttagagaacactactttctttgttttgttttggtttggttttttgagacggagtgtccgtctgtcgcccaggctggagtgccagtggcgcgatctcggctcactgcaagctccacctcttgggttcacaccattctcctgcgtcaacctcgcgagtagctgggactagaggcgcccgccaccacgcctggctaattttttgtatttttagcagagacggggtttcaccgtgttagccactttctttgttaatttaactgttattttaagttcagggatacatgtgcgggtttgttatacaggtaatcttgtgtcatgagagtttttttgcacggattatttcatcacccaggtattaaacctagcaccagttatttttcctgattctctccctcctcctacccagcaccctctgataggccccaatgtgtgttgtttccctctatgtgttcatgtgctctcatcatttagctcccacttataagtgagaacatgtggtatttggttttctcttcctgcattagtttgctaaggataatagcctccagctccatccatgtccctgcaaatgacatgatctcattctttcatatggctggatagtacttcatggtgtatacatacattttctttatccagtctacagttgatgggcatttaggtttattccatgtctttgctactgtgaataatgctgcattgaacatacgtgtgcatgtatctttataataaaacaatttatatttcttgggtatatacccattaatgggattgctggatccagtggtatttctgtttttaggtctttgaggaattgccacactctcacatggctgaactaatttacactcccagtatcagtgtatatgcgttccaattgctccataacttcgccagcatctgcttttttttttttgctttttaataatagccattctgactagtgtgagatggtatctcattatggttttgatttgcgtttctctaatgatcagtgatattgaggctttttttcatatcattgttggctgcatgtatgttttcttttgaaaagtgtctgttcatatcctttgcccactttttaatgggatttttttttcttgtaaatttgtttaagtttcttatagatgctggaatattagacttttgtagatgtatagtttgcaaatattttcccccaatctgtaggttgtctgttcactctgttgataggttcctttgctctgacaaagctctagagtttaattagatcccatttgccaatttttgctttcgttgcaaccaccttttgtgtcttcatcatgaaatctttgcctgttagaaaacactactttcagacatttaaatgcatataggcaatgcttaagtacctaaaaaagcaattttaagaaattactgaggtatctctattaagagtgacatattcatattttattttatgtatatattatttctataacatacaagaaattgttgcatttatcattttaatgcaaagtagtatcaagtataatggattagatgcaaaaataactgaggtaggaatctcagttctgtgttttaatgtggaattcttatgcttattaaaatattttgattagctgttgca

SEQ ID NO: 168276 - DNA, 2186 bp, Homo sapiens
  Payload ID: 13107
  Gene Symbol: KCNV2
  Gene Name: potassium channel, voltage gated modifier subfamily V, member 2
  Uniprot ID: Q8TDN2
  ENST ID: ENST00000382082
  CDS Start-End: 239-1876
gcaagattagagcagtcaacagctgactgcgttcagaccctgcaggctgggctggcctgcccaggacctgagaaggggcagctccggtggcaatgtctgagcccctagctgtgctggtccgggctggcctctctaagacagtgcaggccacgtgatccatcctcctagaggcagtgagcaggtgagggacccctaccacagccaggaggaaaaagctaggcgtccactttccgcagccatgctcaaacagagtgagaggagacggtcctggagctacaggccctggaacacgacggagaatgagggcagccaacaccgcaggagcatttgctccctgggtgcccgttccggctcccaggccagcatccacggctggacagagggcaactataactactacatcgaggaagacgaagacggcgaggaggaggaccagtggaaggacgacctggcagaagaggaccagcaggcaggggaggtcaccaccgccaagcccgagggccccagcgaccctccggccctgctgtccacgctgaatgtgaacgtgggtggccacagctaccagctggactactgcgagctggccggcttccccaagacgcgcctaggtcgcctggccacctccaccagccgcagccgccagctaagcctgtgcgacgactacgaggagcagacagacgaatacttcttcgaccgcgacccggccgtcttccagctggtctacaatttctacctgtccggggtgctgctggtgctcgacgggctgtgtccgcgccgcttcctggaggagctgggctactggggcgtgcggctcaagtacacgccacgctgctgccgcatctgcttcgaggagcggcgcgacgagctgagcgaacggctcaagatccagcacgagctgcgcgcgcaggcgcaggtcgaggaggcggaggaactcttccgcgacatgcgcttctacggcccgcagcggcgccgcctctggaacctcatggagaagccattctcctcggtggccgccaaggccatcggggtggcctccagcaccttcgtgctcgtctccgtggtggcgctggcgctcaacaccgtggaggagatgcagcagcactcggggcagggcgagggcggcccagacctgcggcccatcctggagcacgtggagatgctgtgcatgggcttcttcacgctcgagtacctgctgcgcctagcctccacgcccgacctgaggcgcttcgcgcgcagcgccctcaacctggtggacctggtggccatcctgccgctctaccttcagctgctgctcgagtgcttcacgggcgagggccaccaacgcggccagacggtgggcagcgtgggtaaggtgggtcaggtgttgcgcgtcatgcgcctcatgcgcatcttccgcatcctcaagctggcgcgccactccaccggactgcgtgccttcggcttcacgctgcgccagtgctaccagcaggtgggctgcctgctgctcttcatcgccatgggcatcttcactttctctgcggctgtctactctgtggagcacgatgtgcccagcaccaacttcactaccatcccccactcctggtggtgggccgcggtgagcatctccaccgtgggctacggagacatgtacccagagacccacctgggcaggttttttgccttcctctgcattgcttttgggatcattctcaacgggatgcccatttccatcctctacaacaagttttctgattactacagcaagctgaaggcttatgagtataccaccatacgcagggagaggggagaggtgaacttcatgcagagagccagaaagaagatagctgagtgtttgcttggaagcaacccacagctcaccccaagacaagagaattagtattttataggacatgtggctggtagattccatgaacttcaaggcttcattgctctttttttaatcattatgattggcagcaaaaggaaatgtgaagcagacatacacaaaggccatttcgttcacaaagtactgcctctagaaatactcattttggcccaaactcagaatgtctcatagttgctctgtgttgtgtgaaacatctgaccttctcaatgacgttgatattgaaaacctgaggggagcaacagcttagatttttcttgtagcttctcgtggcatctagctcaataaatatttttggacttga

SEQ ID NO: 168277 - DNA, 11879 bp, Homo sapiens
  Payload ID: 13108
  Gene Symbol: KCNB1
  Gene Name: potassium channel, voltage gated Shab related subfamily B, member 1
  Uniprot ID: Q14721
  ENST ID: ENST00000371741
  CDS Start-End: 197-2773
ccgcgtccgctttcgctttctgcctcgcagccgtcgggatggaggtgagaagacggccgtgacgcgcgcccgcggggccccctgcacccccagcagcccacagcgctccctgcccccctcccccgcagcagcgggccttgccgtcgagtgacagcggcctgggggggcagggggggcgggggcggccggatcagcgatgccggcgggcatgacgaagcatggctcccgctccaccagctcgctgccgcccgagcccatggagatcgtgcgcagcaaggcgtgctctcggcgggtccgcctcaacgtcggggggctggcgcacgaggtactctggcgtaccctggaccgcctgccccgcacgcggctgggcaagctccgcgactgcaacacgcacgactcgctgctcgaggtgtgcgatgactacagcctcgacgacaacgagtacttctttgaccgccacccgggcgccttcacctccatcctcaacttctaccgcactgggcgactgcacatgatggaggagatgtgcgcgctcagcttcagccaagagctcgactactggggcatcgacgagatctacctggagtcctgctgccaggcccgctaccaccagaagaaagagcagatgaacgaggagctcaagcgtgaggccgagaccctacgggagcgggaaggcgaggagttcgataacacgtgctgcgcagagaagaggaaaaaactctgggacctactggagaagcccaattcctctgtggctgccaagatccttgccataatttccatcatgttcatcgtcctctccaccattgccctgtccctcaacacgctgcctgagctacagagcctcgatgagttcggccagtccacagacaacccccagctggcccacgtggaggccgtgtgcatcgcatggttcaccatggagtacctgctgaggttcctctcctcgcccaagaagtggaagttcttcaagggcccactcaatgccattgacttgttggccattctgccatactatgtcaccattttcctcaccgaatccaacaagagcgtgctgcaattccagaatgtccgccgcgtggtccagatcttccgcatcatgcgaattctccgcatccttaagcttgcacgccactccactggcctccagtctctgggcttcactttgcggaggagctacaatgagttgggcttgctcatcctcttccttgccatgggcattatgatcttctccagccttgtcttctttgctgagaaggatgaggacgacaccaagttcaaaagcatcccagcctctttctggtgggccaccatcaccatgactactgttgggtatggagacatctaccccaagactctcctggggaaaattgttgggggactctgctgcattgcaggagtcctggtgattgctcttcccatccccatcatcgtcaataacttctctgagttctataaggagcagaagagacaggagaaagcaatcaaacggcgagaggctctggagagagccaagaggaatggcagcatcgtatccatgaacatgaaggatgcttttgcccggagcattgagatgatggacattgtggttgagaaaaatggggagaatatgggtaagaaagacaaagtacaagataaccacttgtctcctaacaaatggaaatggacaaagaggacactgtctgaaaccagctcaagtaagtcctttgaaaccaaggaacagggatcccctgaaaaagccagatcgtcttctagtcctcagcacctgaacgttcagcagttggaagacatgtacaataagatggccaagacccaatcccaacccatcctcaataccaaggagtcagcagcacagagcaaaccaaaggaagaacttgaaatggagagtatccccagccccgtagcccctctgcccactcgcacagaaggggtcattgacatgcgaagtatgtcaagcattgatagtttcattagctgtgccacagacttccctgaggccaccagattctcccacagccctttgacatcactccccagcaagactgggggcagcacagccccagaagtgggctggcggggagctctgggtgccagtggtggtaggtttgtggaggccaaccccagccctgatgccagccagcactctagtttcttcatcgagagccccaagagttccatgaaaactaacaaccctttgaagctccgagcacttaaagtcaacttcatggagggtgaccccagtccactcctccccgttctagggatgtaccatgaccctctcaggaaccgggggagtgctgcggctgctgtcgctggactggagtgtgccacgcttttggacaaggctgtgctgagcccagagtcctccatctacaccacagcaagtgctaagacacccccccggtctcctgagaaacacacagcaatagcgttcaactttgaggcgggtgtccaccagtacattgacgcagacacagatgatgagggacagctgctctacagtgtggactccagcccccccaaaagcctccctgggagcaccagtccgaagttcagcacggggacaagatcggagaaaaaccactttgaaagctcccctttacccacctcccctaagttcttaaggcagaactgtatttactccacagaagcattgactggaaaaggccccagtggtcaggaaaagtgcaaacttgagaaccacatctcccctgacgtccgtgtgttgccagggggaggagcccatggaagcacacgagatcagagcatctgaactgccctgccttggaggagagacttttgggtgaggtccaaagaggagagctgttcagcttacctgccacagagcttttctgcatgaactctggaacagaaaggccctgtaaagccctcagagagaagagagactccagagaaggctccctaagaccttgagagccatgacaggtccatcagcatgaagttggccaagccatagggcacagcacctccttgtaacaactctatagccctctttgggagatgacatgagtggaactcacagccaccactaccaccactttagacaggaccgaggccacatactccccattctctcgtggctttccatctcagcctcggagggcaacattgacagtcctcctggcttcagctagagaaggatgctggaacaagcggctggtgttgaaagagtgggttgaccaatttggtattgaatgttgcccagccacccctaggaacacctgtccatcacctcctggatggattccactgttagacagctacagggaatgattggtcatggggaagtctctgcgccataagccacgatcccagcgcaaaacccttactcaaatgtcttcattgacttcggtatttcatagtacctgagattttattttgagataccatcagggtgagttgcaccacttgtactcaattctaattgccccctggcaatctgggaagggttcagaaggtgggcacccagccaacagcatgaactcagagcattgttttagggttggaggaggaacacgctttctttacatcactagtgtagactcaaaagatatgcaagtgtcaaatatgcaaaagaaatagtttattcaaagagactgtgtgttactgaagaacagcataaaaatatgatttttttacttgcaaaaatgaaaggaaaaaaataccacgcattgaaatgcccagttcagactgaataattcctgctgcagcaaggaaagtacctactataatagaaattctgttttgttttctgtggttttcaagttaaaaaaaaaaaagttaaaataaaaagcactttatgtttttcaaaaataggttctgccagggacagtgtcaacatcttgcactttaaaataagcactatttcccatagcccaattgttgggactgtagttggattgttgctacctgcccatttctggccagcatgggtaatattgtgctggtattactgtctgccatatcaaagtctgtgggctccttccctgcccctctgaaaccttcccttaaccctcatgggtcaggaggggttcttgccccttgggtggggcctctcatgaagtcaagtatacaggagacatgcacatctcaaaaggacacagtgacagttggacattgggtgttttactctgttctctttcttgtcaaccagctattggtttttcagtgtcactgtctgtactaaaagctcaactctccttcctgcagccatcgatgcagccagtacagacaaaagcaataagtatttgtgtgcatcctgagtggttctggtgtatttcttggtgttggttttcctgtcctcgtttgatgacctggcattgtcctgcctgcttttagtccaacagcatggtgttgttggccattcctcagtacagtggcattaggttgaaccactgatgaatacaatgctatagtgttggctcacctgtcagtaaagatgacatgttattggtctgcctgtctgtagtacaatggaacaatgttgttctcttaatgtaatgttgatggatgatgtcccaagtacaatagtgtagttctgtctatcctcaatacagtaacaggcatatgtcttcccagtggaagaaagatatggtattggttcacctagtcttaagtctcaatatcatctgttgctggtctgcctgttagtacaatggcatgatccacctctcagtacacaaatatcatggagctgttctgcctgctcttcatacataaggcataaggttgagccacctgccacacatatgatgagatgggatcattccaccacccttaaaaatatgtcttctctgctgtatacaaacccaattcataacacttctcagcatctccagagactgtagatccccccaagagggtgcagtcctgttctttgccgcattaacagagaaaacgagaacgtcactcttcctaggtatcttcagagtattcgcgcagcaactgcaaagggacttaggggcagggagagtgtgaggtcatcccgtgccaggcagaggaagcagcactcccaaaacactttgctgaacacgcagtctgagctgggggcctcttgaggaatgactgtgggacagttctccgccgaccatctcacatgtctcttctttgttttcatcaccattaatgtccaccatcagcacaaatgtgaaaattcagggaaaaaaacaaatgctttttgataaaagtaaatagttgtgatttccaattcagatatttttagagctgatgctatctgtaaaaaataataataataataatatagtctattttacatatcaggaaagtgaacatgtttcaatatagccatatatattgagaaggaacttaccaccccttcttccaatcgaggcatttcatttgttggttgaagcagatgagaactgtacagattgaaaatgatttgtttttttttttttttaaaaaaaacgaaaaccaattggtgcaactctccttgtaaccaaaggccctttctgccttctgtggtcatgtaggacctggcccttccttccttgtgtattttgtccaaccgtaaagtagcattttattgagtcacttttgaaggacgaattcagaagtatcattaagaacctaccttttcaggcttcatagccagagtcctatagagttcttatagaaacagaataattgaaattcagcatatactatgcttagaaagtattttgtttgggtttgattgggtttttttttcttttacttgtgtgtgtatgtactgggggagtatagcttttattctgtgctcaattcgaaagagagtattataagttttcccagcccatccacccgctaaaaaagaacatatccaaattttaatatgtatacacccaacctgtacctatgtacgtgaatatacatgcactgggaaatctacttaagagtcttcactgagaagttcactcgatagaaaggtcttgatagagaagagaagaggaaagcaatggtctgaaggcaaatcctgctttaacttggtggtccatttcccattcattcctgaaccaatgagagcagaaagaaacaagtcaacccaaacaagcaaactaggggctggacgcggcgaatggatgctggtcagtttggcaaattcactgaaactcatcaagaacccagctgaacttgcattccaacttccacaattatctgaaagggctagggaccaggtagccatgtgtcccaatcacacgggggagagtctgccaccggcggtgagagaggtggggaagctttggaggagacagtatattcacctttttatctttgggtaaaagaaaccaacaggactttggtgcagtagatttctcagtgccttctttaggaattctatcttaagcacacttcaaggggaaagaaaaaaggaggagagaacatttgttcccgtgaagtccctttctccaaaggactggggatcaagaaggaagaagagtaagaaggaaaaacaacaaaatcctgaggaggccatttcttttaacccacccagcttgcccctgaaaactgctggtgatacaaactttttcaaactgacttccagcttctccatgtgtcttggtaactgtagcctcgtctctgccctttctcctaataagatccatgtttctaaggagaaaaacaaaacagtattctcttctgtaaaactgtaatgtattgttgatatttgtaactattgtatatttctgtcttgctccagtcccagctggagtgtctagttccatggacaaggggatatttaaaattcaccacggacaagagccactaaagccaggtctctatcgctaatctctctcctattcttatttctctaccaactaatctcaagtaacaataccccaggctttttttcagcctcaattcaagtaactttgaatcaaaagagagcaaggcaaaaagcctccggacatgcttctttgggaaaggactttttctgtagctgcagagtgggcaggagggagaaggggctcccctgagaccccggcaggacaatggaaagcttccagccccgagctgatgtttcctcacctatcactgcttataggacagcatccaaatgctttcatgtcactcagcccaggcaacccaaaccagtcctggctacacccagaaataagagttacctctgcattttctgttgccatttttctggctctagaagtatctgatgcgcgactatgtcatagaatgtccacgcatctcagagtagtctatttttctgttcagataaaatatatatatatatgtatttttagcaaatttataatagggcaattgagtctaatttcttcttttgtaatacagaacaatatcttaggagtttcattgttggtcattatcgtagctgatgttttctggtcttttgcagttcctaccattgtcccttgggctgtttgggttttcttccttttgattctgatttcttgagggtggggaaagactttggggtttgacttccttgtgtaggcatttcttgacactaggcctggactctgtcaatgctgtgactttcctcattcatttctgtgtgtttctcccattcgttgttcttaagaatccagggcatgaatgcaggaatgagacccagggaagcagagctacagatggccctcaaaatcaggatgggatgtgggctggtttcacttatatcccacacccctttagggatctgaagggactgagttttctcatccccagagatcttggaaccaaaaatctcatgcaagcaaactcatcactggcatttctgagatccagaacacatgtgagtccctcctggctgggctgctcccacatgtccagcaccctgtcggcctgtaacatcaatcagagctgaaggtcagaggtttttcaggttctcgtgaacctcacaagaacatgctgggcctccgatctcaccaacttgtttatcagttccttgtttcgatctgtttatttatttatttttttgttattattattttgagacaaagtcttgctctgttgcccaggctgcagtgcaatggcgcaatctcggctcactgcaacctcctccacccaggttcaagtgattctcatgtctcagcctcctgagtaactgggattacaagagcgcaccatcacgcccagctaatttttgtatttttagtagaggcagagtttctccatgttggccaggctggtcttgaactcctgacctcaggtgatctgcctgcctcggcctcccagtgctaggattacaggtgtgagccaccactgcacccagtccatttcaatccatttctaacagcttcaccaaaaaacagtggccagacacccttgcagccaaaccctgagaagagatgtccccgaatctgctagctcatctccccttcccttgccagctgcctggctccatagagcaggaggtgtgtggcaaggacaggggcagttttccagcttccacctatccacgcctgggggagtttttggactgtcctgataattaattccagaggcagttttcagtcctgggtgggcggaggacatctcactaggcaggatcttcagcagaaagtgattctccatccgtcaactcatgcaggaagatgaagaaagcccagataatctccaacttgcattcgtttaggttttggtataccacccacctcactgtcagctgcagggcttggggctctgcctagaatcagaaatttgagccaaactgggaccctcagatggcagtgagccatcccatcagataactcccaagaggaagccaactcaaatatgaattttattattctggactatgaccctgatcagagttctcccaccccgaaaacctctgatagtctggtttgaaccagagtcaaataaaacagacaagatttttttttcctctgcacaaaagcaaaaaaacaaaacaaaaaaaagtctgccagtagtttcctgggtttgatgcccagataagcaaacactgttgcctatggctgttgctgttttcatcaagaaagaggttatatagtttgcatttccatccactctccctgattttatcttaacctagaatttctcctgaactaccccaaatgccaacttgaatttgggtagggctctgttaatcgagggaaccctcatcttcacttataaacctaattctctgttcctccctccaaagatcctgaaaagatctcctaaaggctggccaggatggggtggagtggggcagtgcacctgaagaaaaaaacttagctgccagctggctgtatgcaagttctccgaaaatttctattgtatgaaagggatggggtcaattgcagctcaaattaaggaagccctcctaacaggctgggttgtctgaccatggagctcaatgccatggtggacagtgagctcccttatatcacaggtgtttaaagagaggctggctagatggtgtaaaaaatgggcattgcagaggggccctagcattgcatggaaactgggctgaacaaccacagaaattcctctttgtttcttggagtgtgtgtgtgtgtgtgtgtgtgtgtgtgtgtgtgtgtgtgtgtaggtggtttcaacactctggatataagctcaagccactgaggcaaaggcatgcagcacaattagcaggaatgcaacttctgggctttggagctctcagagggggtgtccaagagacaagtctgcttccttccggctccgtcttggaacattttaatgactgtcagtcaccaatccaacccatccccagtggcctaccaggcaccacattgggatgagactcatgctacccttccccaggccagccaaggagcaatccacgctgtcccccatccctggctggctgtcttatggtgcttcagcccctccgcccagctcctgtgccctcatgagcctggggctttctgtataaaagatgcaatgatatctgttccccactagccatccccacaatgaacaacttcccaggcaatagcaaatggctccattccaaaagggcttgtttttttggtaaatcaaataagagaccccactcaagacctttgaaagtccccgtcaatgaaaaaaatccagaagggtcaaaagagaaaggcagcttttaatccagtttcacagcaaaaccaggctcttggctgcctccaagcagaatgccactctcctgcagctgtggcctccatcccaaatcatcctgcatactgcattctctaaggaaagcatttgacaagagagggtttatgtatggtggattgggagaaagtgagacttcaacctcagggtgaaccgaagactggtttgtctttggttgttttagtatgaggttgggcaggatgatatgtttggatgggtagaatgagcagccgccttcctctgaaaccaaaataaaataaaaaccagttttcaagattcctcccaactcctcactggaggctctgccctgcagaatcactcaagttgcaacaacacaaggagacaaaaataggatatttcatgaaaatataagaaactcccaattccgtcccattaggatgccctcaaggggccatgcagggatcttcccatacttcctgcttccctgatctgaaccaagattggaaagaggcaggcagcagagaagatgcccaagaaactctgacatatccacagcttggctctgccccttgggcttcactggggtttgggcctccctcttggttgagctgagtgtgcctgagtgggtggggacagggaggattctccaggtctatcttgatttcataggtccttctcaatccaaggtcaaaaactgagaatcttattttctgcaccaggaactcagggttatccccaacctatgccgctggcacatgatggtcatccaacctgtgtttttgtgagtgagtgaatgtgtgactggttggcctctgagtggatgactggatgcgtgaatgtgtgagtgaatgggggagttaatgaatccctacctaactgtgaagagaagaaaaatgaggagcccctctcccactgaaacccataactgccccatcaaggtcatctttctttgactcaagatgacatctcaatttgatgcttgtaggccccaagctgataagggccacagccctctcagagccacacttcctgggggcccacagagcagctctgccctccttcctcttcccctaccctgcatttctcagcctcatgttctattttagctcacacacgacccatgggggggaccaccaagtggttttccaatggactaagccaagggttcgaagttgggacttcctttggtctgggacttcctggggcagaaacataggagccaacatctggaaactggattgcattccctgagccatgggagtccagctggatattaaggccagcctgccctccagcttttagagccgaagatctttttttctgagccccaaagccgtcatgatagtatgcccccagatcccatcagctaagaccctgtctctcccaggaacccgtcgtgtgaggttggggcttttctgccagtaaagccattctgatcacctcacccttgacaggggccaagccaatcacattagccataaatgaccaatgtcctcagccactcttttctcgggggtgcattcgtgggtcctattcatctctcgtcagttaatgtctctagtccttcctgtaaaggtgaaaataagcattgcgcatgtgcgcaacacacacgcacacacacacacacacacacacacacaaatcccagtgtctttttatgcatgtggtgagatgaaattgtgatctttgtgtgacctccagctgctgtcttgtcttgtaaaatatgtccaaatgtttaagaatttctaagcaaatggtcccttaatgaagtctgcagagttcaataaaaggtatggaaaaaacaa

SEQ ID NO: 168278 - DNA, 4114 bp, Homo sapiens
  Payload ID: 13108
  Gene Symbol: KCNB1
  Gene Name: potassium channel, voltage gated Shab related subfamily B, member 1
  ENST ID: ENST00000635465
  CDS Start-End: 523-3099
gcgctccgaagtgcgggacagaatagcagcgagcgcggagccgaagctcagccccgacttgttgatctcgcccaggcagccgccgccgccgccgccgcgggagcaggaggaggaggaggtggaggaggtgccgcgcggccgcggtcctgcccccgcgcccccggcgcccgccggcgccccccgcctcggagagcgcgccccggccccgcggcgcctgcagcccgggcgagttgcctgcccggccggggtaggcccggctcagcccggccccgggaccgccgctgcccacgggcgggggcgcccgggcggccgggacgatgcgcggtccctggccccaggaggcggccgccctggggccgtcgggatggaggtgagaagacggccgtgacgcgcgcccgcggggccccctgcacccccagcagcccacagcgctccctgcccccctcccccgcagcagcgggccttgccgtcgagtgacagcggcctgggggggcagggggggcgggggcggccggatcagcgatgccggcgggcatgacgaagcatggctcccgctccaccagctcgctgccgcccgagcccatggagatcgtgcgcagcaaggcgtgctctcggcgggtccgcctcaacgtcggggggctggcgcacgaggtactctggcgtaccctggaccgcctgccccgcacgcggctgggcaagctccgcgactgcaacacgcacgactcgctgctcgaggtgtgcgatgactacagcctcgacgacaacgagtacttctttgaccgccacccgggcgccttcacctccatcctcaacttctaccgcactgggcgactgcacatgatggaggagatgtgcgcgctcagcttcagccaagagctcgactactggggcatcgacgagatctacctggagtcctgctgccaggcccgctaccaccagaagaaagagcagatgaacgaggagctcaagcgtgaggccgagaccctacgggagcgggaaggcgaggagttcgataacacgtgctgcgcagagaagaggaaaaaactctgggacctactggagaagcccaattcctctgtggctgccaagatccttgccataatttccatcatgttcatcgtcctctccaccattgccctgtccctcaacacgctgcctgagctacagagcctcgatgagttcggccagtccacagacaacccccagctggcccacgtggaggccgtgtgcatcgcatggttcaccatggagtacctgctgaggttcctctcctcgcccaagaagtggaagttcttcaagggcccactcaatgccattgacttgttggccattctgccatactatgtcaccattttcctcaccgaatccaacaagagcgtgctgcaattccagaatgtccgccgcgtggtccagatcttccgcatcatgcgaattctccgcatccttaagcttgcacgccactccactggcctccagtctctgggcttcactttgcggaggagctacaatgagttgggcttgctcatcctcttccttgccatgggcattatgatcttctccagccttgtcttctttgctgagaaggatgaggacgacaccaagttcaaaagcatcccagcctctttctggtgggccaccatcaccatgactactgttgggtatggagacatctaccccaagactctcctggggaaaattgttgggggactctgctgcattgcaggagtcctggtgattgctcttcccatccccatcatcgtcaataacttctctgagttctataaggagcagaagagacaggagaaagcaatcaaacggcgagaggctctggagagagccaagaggaatggcagcatcgtatccatgaacatgaaggatgcttttgcccggagcattgagatgatggacattgtggttgagaaaaatggggagaatatgggtaagaaagacaaagtacaagataaccacttgtctcctaacaaatggaaatggacaaagaggacactgtctgaaaccagctcaagtaagtcctttgaaaccaaggaacagggatcccctgaaaaagccagatcgtcttctagtcctcagcacctgaacgttcagcagttggaagacatgtacaataagatggccaagacccaatcccaacccatcctcaataccaaggagtcagcagcacagagcaaaccaaaggaagaacttgaaatggagagtatccccagccccgtagcccctctgcccactcgcacagaaggggtcattgacatgcgaagtatgtcaagcattgatagtttcattagctgtgccacagacttccctgaggccaccagattctcccacagccctttgacatcactccccagcaagactgggggcagcacagccccagaagtgggctggcggggagctctgggtgccagtggtggtaggtttgtggaggccaaccccagccctgatgccagccagcactctagtttcttcatcgagagccccaagagttccatgaaaactaacaaccctttgaagctccgagcacttaaagtcaacttcatggagggtgaccccagtccactcctccccgttctagggatgtaccatgaccctctcaggaaccgggggagtgctgcggctgctgtcgctggactggagtgtgccacgcttttggacaaggctgtgctgagcccagagtcctccatctacaccacagcaagtgctaagacacccccccggtctcctgagaaacacacagcaatagcgttcaactttgaggcgggtgtccaccagtacattgacgcagacacagatgatgagggacagctgctctacagtgtggactccagcccccccaaaagcctccctgggagcaccagtccgaagttcagcacggggacaagatcggagaaaaaccactttgaaagctcccctttacccacctcccctaagttcttaaggcagaactgtatttactccacagaagcattgactggaaaaggccccagtggtcaggaaaagtgcaaacttgagaaccacatctcccctgacgtccgtgtgttgccagggggaggagcccatggaagcacacgagatcagagcatctgaactgccctgccttggaggagagacttttgggtgaggtccaaagaggagagctgttcagcttacctgccacagagcttttctgcatgaactctggaacagaaaggccctgtaaagccctcagagagaagagagactccagagaaggctccctaagaccttgagagccatgacaggtccatcagcatgaagttggccaagccatagggcacagcacctccttgtaacaactctatagccctctttgggagatgacatgagtggaactcacagccaccactaccaccactttagacaggaccgaggccacatactccccattctctcgtggctttccatctcagcctcggagggcaacattgacagtcctcctggcttcagctagagaaggatgctggaacaagcggctggtgttgaaagagtgggttgaccaatttggtattgaatgttgcccagccacccctaggaacacctgtccatcacctcctggatggattccactgttagacagctacagggaatgattggtcatggggaagtctctgcgccataagccacgatcccagcgcaaaacccttactcaaatgtcttcattgacttcggtatttcatagtacctgagattttattttgagataccatcagggtgagttgcaccacttgtactcaattctaattgccccctggcaatctgggaagggttcagaaggtgggcacccagccaacagcatgaactcagagcattgttttagggttggaggaggaacacgctttctttacatcactagtgtagactcaaaagatatgcaagtgtcaaatatgcaaaagaaatagtttattcaaagagactgtgtgttactgaagaacagcataaaaatatgatttttttacttgcaaaaatgaaaggaaaaaaataccacgcattgaaatgcccagttcagactgaataattcctgctgcagcaaggaaagtacctactataatagaaattctgttttgttttctgtggttttcaagtt

SEQ ID NO: 168279 - DNA, 3582 bp, Homo sapiens
  Payload ID: 13109
  Gene Symbol: KCNB2
  Gene Name: potassium channel, voltage gated Shab related subfamily B, member 2
  Uniprot ID: Q92953
  ENST ID: ENST00000523207
  CDS Start-End: 589-3324
cgccgccgctgcgcctcgggcagccccagcgagcggcaactcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagccggggagaccctcctctctgtggaggggagggggatttccagcgacaggtcattggcgaaggggatcgtcgcggggagaggctccccggagggagcggggaatcccacagccctttgtggtgcccgagcccgtgccgcctgctgagcggggtctgtgggagctagctttgtcagtggaaatgcctgccccagagggatattgcttcagttgacctcattttttaaggaccctggctctgcggctttgtccagttcaaaatggcagaaaaggctcccccgggcttaaacaggaagacttcaaggtcgacactttcccttcctccagagcctgtggacattatccggagcaaaacatgctccaggagagttaagatcaatgtggggggcctcaaccacgaagtcctgtggagaacgctggacaggctgcccaggacgcgcctggggaagcttcgagactgcaacacacacgagagcctcctggaagtgtgcgacgactataatctgaacgagaacgagtatttctttgatcggcatccaggagccttcacttccattttaaatttctaccggaccgggaaactccatatgatggaagaaatgtgtgcactttcgtttggccaagaacttgattactgggggattgatgagatctacttggagtcctgctgccaggccagatatcatcaaaaaaaagaacaaatgaacgaagaactgaggcgagaggcagagactatgcgagagcgagaaggagaagagtttgataatacctgctgccctgataaaaggaagaaactgtgggacttgctggagaaacctaactcatcagtggctgcaaagatcctggccatcgtgtctatcctgttcattgtgctttccaccattgctttgtctctcaatacgctgccggagctgcaggaaacggacgaatttggacaactcaatgacaaccgccaattagcacacgtggaggctgtgtgtattgcatggtttaccatggagtaccttttgcgattcttatcctcaccaaataaatggaagttcttcaaaggcccactgaatgtcattgatttgctggccatcttgccgtactatgtcaccatttttctgacggagtccaacaagagcgtgctgcagttccaaaacgtgaggcgcgtggtccagatcttccgaatcatgcgcatcctcaggatcctgaaactcgccaggcattcgacaggcctgcagtctctgggtttcacccttaggcggagttacaatgaattgggcttgttgatattgtttctggccatggggataatgatattttccagcctggtattttttgctgagaaggatgaagatgctaccaagttcaccagtatccctgcatcattttggtgggccaccatcaccatgaccactgttggctatggtgacatttaccctaaaacattactagggaaaattgtgggaggtctgtgctgtattgctggggttctggttattgcccttcctatcccaattattgtgaacaatttttctgagttttacaaggagcagaaacgccaagagaaagcaattaaaaggagggaggctcttgagcgggccaaaaggaacggaagcatcgtttctatgaacttaaaagatgccttcgctcgaagtatggaactgatagatgtggctgttgagaaggccggagagtccgccaacacaaaggactccgccgacgataatcacctgtcgccaagccggtggaagtgggccaggaaggctctgtcggaaacaagctccaacaagtctttcgagaataagtaccaggaggttagccaaaaagactcccacgagcagctgaacaacacgtcttcctccagcccacagcatctgagtgcccagaaactggagatgctatacaatgaaatcaccaagacacagcctcattctcacccaaacccagactgccaagaaaagcctgagaggccatctgcatatgaagaagagattgaaatggaagaagtggtgtgtccacaggagcagctggccgtggcacagaccgaggtcattgtggacatgaagagcacctccagcatcgacagcttcaccagctgtgccaccgacttcacagagacagagagatcgccgctgccgccgccctccgcctctcacttgcagatgaagttcccaaccgacctcccagggacagaagagcaccaaagagctaggggccccccgtttctaactctatccagagagaaaggacctgctgccagggatggcacgctggagtatgccccagttgacataactgtgaacctcgatgccagtggctcccagtgtgggctacatagtcctttgcagtctgacaatgccaccgacagtcctaagagctctctaaaaggcagcaacccactaaagtccagatccctcaaagtgaactttaaggaaaatagaggcagtgcaccacagaccccgcccagcacagccaggccactgccagtcaccacagctgacttttcgctcactaccccgcagcacatcagtaccatcctcttagaagaaaccccctcccagggagacagacccttgctgggcactgaggtttcagcgccttgtcagggaccttccaaagggctgtcccccaggtttcccaagcagaaactgttccctttctcttcaagagagaggaggagcttcactgaaatagatactggtgacgacgaagacttcttagagctcccaggggcaagggaggagaagcaggtggactccagcccaaattgctttgcagataagcctagtgatgggagagaccctttaagagaagagggcagtgtgggctcttcctccccgcaggacacaggtcacaactgtaggcaagacatttaccatgctgtgagtgaagtcaaaaaggacagtagtcaagaagggtgcaagatggaaaatcacttgtttgccccagaaattcattccaacccaggagacacaggttattgtcccacacgtgaaaccagcatgtgactagttacaaaagcaataaattgaaacaaaacaaaacaaaacaaaacttgtttcttaaaaatgcggttaataatgcctgtgaactaaaaaaatgggaagccctccccaaaaaaagtgcataaaatgttatttttgcatggcatgaacagtttagcttaagtactgtttaaataatgagtcaagactgcattttgtaacaaaccaacaaaaatgactgaagaacagtgaacaaataaaaagagctctattaggaaccaa

SEQ ID NO: 168280 - DNA, 7976 bp, Homo sapiens
  Payload ID: 13110
  Gene Symbol: KCNA1
  Gene Name: potassium channel, voltage gated shaker related subfamily A, member 1
  Uniprot ID: Q09470
  ENST ID: ENST00000382545
  CDS Start-End: 1108-2595
agaaatggaccgagcggacccgccgccgcacgcaccctgctccactccaagctcctaagggctcctggcgcgccgcgtagccttggcgaggtccgcgctggggtgcggagagcgaagggaactggagagccatgtagatccaggctctcgcccgcccgcctccttcgggatcgaatcaagggctcccatagtgttaggagggggcgagagtgctgtttatcgtcatttgcctcggagcttcgagagagggtggtattttgcttttccgccccgcatcctccggaactccctgcaccggagagaggacggcgtctccaggttgctggcaaccggtgagaatgggggtagggaaggaacattttcgccgtagctgctccgtaaagcgattgtccaactgagaggggcgtcggacgagtggaccagggcggcgagtttgcccggcgcgtctcggatgctgctgcggcggccgccgcggctcccgccagggcactgcaaagacgacctgccgcattcccactcgggctctccgctgactcagcaccgcccctgcgccaagccagccggccagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggcccagtccgctagaacggcactgcgttaaggcacctgggatcaggaagaaatatctaaacaacaacaacagaaaaccaacaaacccccaaacccaaacccaaccctctgcaaaaagctgcacccggcccgcaggcgagggggattccaaactgagtgaaaggcagggtggaggggaaggcagcgagaggcaaagtcgcagatctcccgacctgctcgtgttgaagcacctccccctgggcgtgagggagacgcgcgctccggtgggggggccgcttgggtcccccccacccctggtccctggctgcttcccaccccgggctctctcctggcctcccacccccgcgcccggcttccaccatgacggtgatgtctggggagaacgtggacgaggcttcggccgccccgggccacccccaggatggcagctacccccggcaggccgaccacgacgaccacgagtgctgcgagcgcgtggtgatcaacatctccgggctgcgcttcgagacgcagctcaagaccctggcgcagttccccaacacgctgctgggcaaccctaagaaacgcatgcgctacttcgaccccctgaggaacgagtacttcttcgaccgcaaccggcccagcttcgacgccatcctctactactaccagtccggcggccgcctgcggaggccggtcaacgtgcccctggacatgttctccgaggagatcaagttttacgagttgggcgaggaggccatggagaagttccgggaggacgagggcttcatcaaggaggaggagcgccctctgcccgagaaggagtaccagcgccaggtgtggctgctcttcgagtaccccgagagctcggggcccgccagggtcatcgccatcgtctccgtcatggtcatcctcatctccatcgtcatcttttgcctggagacgctccccgagctgaaggatgacaaggacttcacgggcaccgtccaccgcatcgacaacaccacggtcatctacaattccaacatcttcacagaccccttcttcatcgtggaaacgctgtgtatcatctggttctccttcgagctggtggtgcgcttcttcgcctgccccagcaagacggacttcttcaaaaacatcatgaacttcatagacattgtggccatcattccttatttcatcacgctgggcaccgagatagctgagcaggaaggaaaccagaagggcgagcaggccacctccctggccatcctcagggtcatccgcttggtaagggtttttagaatcttcaagctctcccgccactctaagggcctccagatcctgggccagaccctcaaagctagtatgagagagctagggctgctcatctttttcctcttcatcggggtcatcctgttttctagtgcagtgtactttgccgaggcggaagaagctgagtcgcacttctccagtatccccgatgctttctggtgggcggtggtgtccatgaccactgtaggatacggtgacatgtaccctgtgacaattggaggcaagatcgtgggctccttgtgtgccatcgctggtgtgctaacaattgccctgcccgtacctgtcattgtgtccaatttcaactatttctaccaccgagaaactgagggggaagagcaggctcagttgctccacgtcagttcccctaacttagcctctgacagtgacctcagtcgccgcagttcctctactatgagcaagtctgagtacatggagatcgaagaggatatgaataatagcatagcccattatagacaggtcaatatcagaactgccaattgcaccactgctaaccaaaactgcgttaataagagcaagctactgaccgatgtttaaaaaacaaaggcaagcaaacaaaaaagccccacttagcagctcaaaagacttaaaaaacaaaacagaaaacctagtgactcatgtcacgctttgtagatactttactaagtagacttggaatgctctatttaactgtcaatgcgttgttgcattgaggattttgggggtggtgaaccagaagctttcaagatccatgacaaaataaactattttccttttattaaaaaatgggaaaagagagagtattttctaaaactggcttaaaaagattcagtccacgaactagtctaggtaaaataataatcatatgcttccccaaactgaaacatttttaatgctttggtttctttaacttttttaaaaactcagaacaagatgatcacttagaaatatgaaattgaaattcgcatgggactccagtaaaacatctttgcaaactgcgtagcacattgaagacagtgcatcagatgtattatatgtaacatgatagaccagccaaaatggacaatgaatagatatttttatttcgatcaactgaactgcatattacaaggtgaaaaaagaaaactccgattacttaagactggttcacaaagcaccttataaattggatactggtcctgatctgtagggatttccccctgggcccattctctttctaatccagattattctctaagaaaaagttaactgaattaaattaattgattcttctgcagtgccgctaaatggtctcaactgcagatgagccaaatacaggtcttttctcaccaggcctgcactccgacccctggctttcagaactggatgtaaaaccttagcctccttattgcaagagagcacaaatgaagttaaatgtaagcatgtttgaatctgatacaatttattttataatcgcatgctgagaagttaacccagacaataggggataagcttaagttgaaatcgattcttctaaaaatagatcctttttcatttgcattcaccaaaagtgcactcctccatttattaactattttattagtaaataaagtactgtatttaagtgcatatgttagtcagatgggaacaataactttttggagctcaaagcatgttctcttattcagcattatggcctatttgactaagatgtaccttgaattaattaatgcatgatttcagtaataaaaattttaaaagtaataaaaattacaagtctgtggggtgaaaggcccaatagaaattatggggggtgggggtgggggcactcagtcaattttcctgcctttgctcagggaaataccaggtttttgtgcaggtataggcggagagaggaccaatatgcccatcccttaaagggaagccatgtgaaaaactcaataagtcatcaaagtacatatagcaacacctaagaacaagtattctttctagctgaagacaaacacaagcaacacaaacaagcaaacaaacaaacaaacaaaaaggtgcaatactgcatgttttttggtgcattcttaggatgtaaatgaaaatgtttctctattatatgcatccgaagcagagctgatttttttttctttgcagtcattctttgaagtctgtagagacttcagccctccccttgaggctccctgaagaaactaaaccaattgatttaatagttgcttagtgcctttatcctgtacccacagtgaactgtagaaagtgcctccttaacacagctgagaagttaggtagcaaaagtggggaagggttggggcacagaccttttgctttttctttttccattctcgctctctcatttcaccactgtgagaagaccacaccaccctaaaccctggagaggagagacccaggagggtgctgtctctctggccatctactagcattggtccctttgacagcctgacgctggatgtgaactgagacccatctttgaactggacatgaactgtgaacttgttttttcctctctccaccaaagccaagataaactttttgggaatttgtttcctatcgagggccactttggacacacaaggcttcctcaggtccagtgtagtgctcctggcacctttccttatttttttctctgtcggtaacagcactttgcaaatctctctgacggtccagtcttttcaggcattgttgtggatgtgggaacactcagttcataataacctttcctaggccttccctcctggtctacccctttcagatatttcctgatgcccctatgatcttcccacctggcagtcacttcacaggttgaacatctaacttctgctgcccccccgttacccagcccagagaatggtggggaccctgttcctggctgaaagagagccacggaacacaggcctctggagctcggcagctgcccaccggtggagaggtactcacagcctttcaaaggaccctgaggtggggaatcttcattctgcacttagcatgtggctgcctgttacctgacattctggcccagcttcttctgaaaatctgtcctgcttctcccacccctttcccccatcctgtcctagaactagcagtgaggcaatcaccctagaaactcgagttacacccattctggctaactcgattaaaagaaagaacatggatatcttattttcctatgtgacttttgtgaatctgtgagatgaacacaacacacatcgtggaagatgaggggccaagaactgcgcagcatccgactacagggcattaaaccctcccatgtgatgtctccttctcgtctgaaccttaactcattctggcgattcctttcctacttgcttaaaaatccccaattaggaaaaaaatgccaacctcctcccaggcttggggttatcttgatctttcatttcaacgttgaggtctagtgcacacagaacttgaaacaccgcactctgtcaacagcaataatccactcagtactgtgggatggatgggttaatggatgagaaaacggcaccaagactgactttgggtatttggtatatttaccgtggttacactctggactggttgattcttctgcatgtgatatagaaaaaagtgctgcatgcggtgaacctgtcagtctgggactgggggtgagttgttgttatgagtttggggtggtgtgaggaaagtgaatgctgcttagctcatctgtagctcattgcaatgaattcagtaagaatggagtacagggattatctgtgtagcataggcatgcaatgtttgaccaagctcttaccctcgcactgtaatgtgttgaaatgtctttgtagacctgaaggtgcacttaacaaaactgcctattaagggatgactattttttggtttacttattcatatttattttagcagcctttttaccttttcttccccttcctaggcatggagctgtaacagctcatgtcctgactatgtgttttctccagaaggagaagacttctgatgtgctgatagctataattcctctcttccagtctattggggccctagttcaatagggtggcaatagaagagttggtcacaccagggctgttagccatcccagaatctctgaagtggttaactcacctgaagtgatctgaatcagagagaccaaagacattcatttcctctgtcctcagatttctagaagacaaattctagccaggaaaactttctgtttttgcatctcccttttcccatttgtgcccaactccccttgcactccctggagacttgagttctgattttcagttatatcagctcattgggagtgtgttcgtgggtgagccttgcagaatcagataaaccaatagcaagtccttctccaggattctggccagtgggcagtcatttccctgaaatgaattgtagggcaggtttagattccactatggtggacgtgaagcacaggtggtgtcacaatcttgatttgcttgagaattaaaaaaatacatgtaaatggtaaatgaggaatacatttttttaaagtagaaatttggtttagcctataaaaggccttcttcacattgtgtatagttacacgtttttcaaattaggtaccatctaaaagtcaataaaaatagtttcctagccctctcatttaatataggagacctcaaaacacatgctttttaacaattttacattttaattcttagtttggtagattggattgaaagaaaggagaaagaacattagcagaaggcactttcccattttcttccaggaatgacttattcctggggtggtgagaattggtgggtggtaaccatccatagtataaaattgttagaaagaatataaactgccaaacaagcatgttatcttcaggcttttccaagcaagaatgaagtcttttgatgtttatgttcattttaagaagacaaacaaactaaaattttaagaccagacacaacccaagttgaattgtgatctcaggaggtgaactctcattcaccatgtggcatattactacctgtatttatatcatggaatttcagggtatatgtgaacatgtctagtatgactcaggtaaacctttaaagaatgtatgttacttaccatttttgtaaagaagcaaacaggagctgaattgttaaccaaaactgttccattaccttgggtcactgtgcaaactaattcagggtacagatataaagtttagaagccttgggattaaatgccagcctctttgctcaggcaaaatgaccctgggctttcttgggaagtccagcatgtatgtaaggggtgaggccctgctgacctcagggcttttcgctttaaggagattaaccctagtcacagtgattttcatttaggagctaactaggagtttactctttatgacgtgaaacttcaaagagtatagaaaacttttgtaccacaatcaaagaagaagaaatggtgtatggaaagaaaacaaaacaaaacaagaaatctcttgtaaaatattccaggtcaaagttgtctcctctccaaaccttgcagaagcacctttcttctcttcagcgcactgttttgggactgtttatgcagcagatgtaagtagacaacatggactccatgtgacatgcctctaatagtaaagataaagtattactgaggttaaaaataaaaattgagtagtattaatttaaagtgcaccatcaggacaacaaaccatttaagctgaaaaaacgctattttatttcttgagtttgccagttgcttccaccttgagttaaggacgtgtctcatcttcacctactgcgcattctcccttctctaactgtgtaatatgtcaggtcaaggacattgaatgttatgaattgagaacctaattgatgcgcatagttttcatctatgcaattttacttgcttctgtcactttacgatctgttcatatttggcatcaattaaagatactttttaaggatctt

SEQ ID NO: 168281 - DNA, 1588 bp, Homo sapiens
  Payload ID: 13111
  Gene Symbol: KCNA10
  Gene Name: potassium channel, voltage gated shaker related subfamily A, member 10
  Uniprot ID: Q16322
  ENST ID: ENST00000369771
  CDS Start-End: 52-1587
gcaggcagtgaaggctgaggatcttcatgcttcttccctggctcccctagaatggatgtgtgtggctggaaagaaatggaggttgcgctggtcaattttgataattcagatgaaatccaagaagagccaggctatgccacagacttcgactcaaccagcccaaaaggccggcctgggggcagctccttctccaacgggaagatcctcatcagcgaaagcaccaaccatgagacggccttctccaagcttccgggagactatgctgaccccccagggcctgagccagtggtcctaaatgaaggaaaccagcgggtgatcatcaacattgctgggctgagatttgagacccagctcagaacccttagtcagttcccagagactctcctgggagaccgggaaaaaaggatgcagttctttgactccatgagaaatgagtatttctttgatcggaaccggcccagttttgatggaatcctatattattaccaatctggtgggaaaattcggcgcccagccaatgttcccattgatatctttgctgatgaaatctccttctatgagctgggtagtgaggccatggaccagttccgggaggatgaaggcttcatcaaagaccctgaaacactgctacccaccaatgacatccaccgtcagttctggctcctctttgagtaccctgaaagttccagcgctgcccgtgctgtggccgtggtctcggtgttggttgtggtcatctccatcaccatcttctgcctggagacactgccagagttccgggaggatagggagctaaaggtggtcagagaccccaatctcaacatgagcaagacagtcctctcccagaccatgttcaccgaccctttcttcatggtggagtctacctgcatcgtgtggttcaccttcgagctggtgctccggttcgtggtctgccccagcaagactgacttcttcaggaacatcatgaacatcattgacatcatctccattatcccctactttgcaactctcatcacagagctagtccaggagacagagccgagtgcccaacagaacatgtccctggccatcctgaggatcatccgcctggtgagggtcttccgcatcttcaagctctcgcgccactccaaggggctgcagatcctcgggcaaacactgaaggcgtccatgcgggagttggggttgctcatcttctttctcttcattggagtcatcctcttctccagtgcagtctactttgctgaggtggatgagccagagtcccatttctctagcattcctgatggcttctggtgggcagtggtcaccatgacaactgtaggctatggggacatgtgcccgaccaccccaggggggaagattgtgggcactctgtgtgccattgcaggggtcctcaccattgccctccctgtgcctgtcattgtctccaacttcaattacttctaccaccgggagactgagaatgaagaaaagcagaacatcccaggagaaattgaaagaatcctcaacagtgtaggctcaagaatgggcagcacagactctcttaataagaccaatggtggctgttccacagagaagtctaggaaatgat

SEQ ID NO: 168282 - DNA, 2150 bp, Homo sapiens
  Payload ID: 13112
  Gene Symbol: KCNA2
  Gene Name: potassium channel, voltage gated shaker related subfamily A, member 2
  Uniprot ID: P16389
  ENST ID: ENST00000316361
  CDS Start-End: 622-2121
gtgctccctgccgaggagatgtgagggattttctcttgggggagaaatcagtggtcgagcgcctgcccagctcaaatgccacccggctcagagggaggcctgcggcccagggatcccggagggagagcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctca

SEQ ID NO: 168283 - DNA, 1959 bp, Homo sapiens
  Payload ID: 13112
  Gene Symbol: KCNA2
  Gene Name: potassium channel, voltage gated shaker related subfamily A, member 2
  Uniprot ID: P16389
  ENST ID: ENST00000369770
  CDS Start-End: 576-1646
ggcacatagaagagtgagccatcatctggtttccagcgccaagacttctgcaggagagcctccgctgggctttcaagttggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcagacaccagctgtaactacattgcacaggatgtattgatattatcattcttgctgacatattctggaagctttcagccccaccaacactgccccacccaggacttctgcagctgagagttcctgtgtcagtagggtctgatatttgtacataggttatacatatatgtgtacatatgtgcctcaatgaacattgcctgtccacctgatcatgggtgtacatagacttcatagagctccacagtcttttgtaaatattgacacaagtaaataagtatataaatatatattactggggatttattttaacatcattctgtgtgatatgaaaaaaataaaatttttgacagaca

SEQ ID NO: 168284 - DNA, 2530 bp, Homo sapiens
  Payload ID: 13112
  Gene Symbol: KCNA2
  Gene Name: potassium channel, voltage gated shaker related subfamily A, member 2
  Uniprot ID: P16389
  ENST ID: ENST00000485317
  CDS Start-End: 746-2245
aaggggtcgcgctggcgggagaaagggcaagaaaggggtctgcagatcctgtctggaggcaccacaataatagcaacacgtctctcccggggctggatcccgctgtgggcctggggtagctgctattgattatctcctccttgcctacttcattacgttggcaggagcctctcaccagtgcccctcaacttctgccctcccccatctccccggcccggcagcacccagctgagctctcctggaggttctggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacac

SEQ ID NO: 168285 - DNA, 11877 bp, Homo sapiens
  Payload ID: 13112
  Gene Symbol: KCNA2
  Gene Name: potassium channel, voltage gated shaker related subfamily A, member 2
  Uniprot ID: P16389
  ENST ID: ENST00000633222
  CDS Start-End: 675-2174
ggcgctgcgtggcgcggtgcggctgcgggcggcggccgggagctccgtacgcgccgcccgcgggactgcagagccggctcccggctggccgcccgcaccccgccgccgcccgctgccggggttctgccggcgctggccgtaacctaggaacatggaggccccggtgcccatccggaagggcaacgtcacacctcctgaggacagccaggactccagcttttgctgagctttgcatcttgcctccttccttcaaaaggctccaggcccatgctcggctgtcttcaagtcccgcatgcccctggccaggcacctcaccgcccctccagcccagcccaatcctagagctcacctccaggacccagagtctgcccttctgcccagaatgactcaccattatttctagctcgagtgagaagacgtgatgaggagttgggctgcctgttggtgcatctcagattcctgcagcatctgatcagctctgcaaggaagagagcttcacgtctctggtcagccaagcgaggctgtctctccagctctcagagagctctcggggctctcctgcaggagaccaggccaatgctcctgtgcttcctggggccagtagcagcaccctgagctccctgccaccaggcagctgaaaggcatagcgtgaggtgcttctctcagtcccaattatgacagtggccaccggagacccagcagacgaggctgctgccctccctgggcacccacaggacacctatgacccagaggcagaccacgagtgctgtgagagggtggtgatcaacatctcagggctgcggtttgagacccagctaaagaccttagcccagtttccagagaccctcttaggggacccaaagaaacgaatgaggtactttgaccccctccgaaatgagtactttttcgatcggaaccgccctagctttgatgccattttgtactactaccagtcagggggccgattgaggcgacctgtgaatgtgcccttagatatattctctgaagaaattcggttttatgagctgggagaagaagcgatggagatgtttcgggaagatgaaggctacatcaaggaggaagagcgtcctctgcctgaaaatgagtttcagagacaagtgtggcttctctttgaatacccagagagctcagggcctgccaggattatagctattgtgtctgtcatggtgattctgatctcaattgtcagcttctgtctggaaacattgcccatcttccgggatgagaatgaagacatgcatggtagtggggtgaccttccacacctattccaacagcaccatcgggtaccagcagtccacttccttcacagaccctttcttcattgtagagacactctgcatcatctggttctcctttgaattcttggtgaggttctttgcctgtcccagcaaagccggcttcttcaccaacatcatgaacatcattgacattgtggccatcatcccctacttcatcaccctggggacagagttggctgagaagccagaggacgctcagcaaggccagcaggccatgtcactggccatcctccgtgtcatccggttggtaagagtctttaggattttcaagttgtccagacactccaaaggtctccagattctaggtcagaccctcaaagccagcatgagagaattgggcctcctgatattctttctcttcataggggtcatccttttctctagtgctgtgtattttgcagaggccgatgagcgagagtcccagttccccagcatcccagatgccttctggtgggcagtcgtctccatgacaactgtaggctatggagacatggttccgactaccattgggggaaagatagtgggttccctatgtgcgattgcaggtgtgttaactattgccttaccggtccctgtcattgtgtccaatttcaactacttctaccaccgggagacagagggagaggaacaggcccaatacttgcaagtgacaagctgtccaaagatcccatcctcccctgacctaaagaaaagtagaagtgcctctaccattagtaagtctgattacatggagatccaggagggtgtaaataacagtaatgaggactttagagaggaaaacttgaaaacagccaactgtaccttggctaacacaaactatgtgaatattaccaaaatgttaactgatgtctgattgaaacctattaccgtactcacagctcaatggaactaatgcagatgttgcataatagcctgcattgtagtcagtgtgttctacagtgtgtatctggttctgcatggaaagcaatagttgtgcaagtgacttttgatcttttgacttttgatttagaacacagaatatctatcatggctttcatgcacatcctcatcaccggcttatgaacttccaaagacgggagtcacctatcaagctaggatttcagatagacacgttgaggccacctcatatcccatacacagtgcaccatatcagtgccatcattccttcctaatgaaatgcacacaacatccaagagatgcactcccctccccaccatcccaccaccttatttgagcccacctgccctttcacagaggaacacaatcatggcttagctttaaatagctggtgtttgttcaaaaggtcatactcatttttgcattgaaaagaacacacagtcctgtgtgttggaattactttctgtgtcacaggctggagtttgtgaattgcagttgccaagtagatgctctggaggcttgtgtttcataacggaaaatgctgcattctgctttttctctgcagtgtcgatgtgagggaagcccgggggagggacagttagtatgaccgaatatgagttgtcaagtttcacatttgttcccttaggcctatggggagaagctaacaaaccaacagacctctaagcctctgatttcaccatttttgcaggctccagggtcacaaaaacatgtctggtttcttactggagtttgcagacatctgctttcccactgatgtggcccagctacactgacactgcagtgaaatttaccagtgatgcaatagagctgcatgggtgtttgttgcatgaatctcaatatttaaaacacaggagataacctattttcctagtagcctacacagtgttaatatttagagtattaataggcttggaatggtcttgaactaggggtttttttcccatcagaaggcaaaaatccctccatcaggggaaaaaaaatagactatttggaatggaactaaaacttctggccccccagcctacctatccctgttcttctaaacaggaacgcagacctctgcaaagccagaagagtaagcggggaaggcagcatctgaacacctcacatgactgcaccttaggaattaacctagtcgcgggcatgactgtacagtggaccagggcatctggtcctgatgacaggcaggtctgtggatccagtgtatataaatatatatcgagtatctctctttcacgcgttcctctacctagctagtgatagaaaagaaattgcatttgaacattgtacaagcttatgcaatatttttgacaaagggcaatttatgcatgtgtttgactatgtgcactagggtgtatatatatacatacatatgtgtgtatatgtatacacacacacacacacacacacacacacacacacatatatatatatatatattcattttctggagttcaggttcaggagcaaatccactgcttggtgggttggctgtctaagaggcctaatgggttaatttgtctcattggtaaccccactgggcctgggtttgctgccattgcctcagacactccggtatccatggattcctagacgttagaattgtctttctgccctccatgtgctgcagcttcagttcccatggctgaagcttgtcttactgagtgcacaagggccctgtggccctcacagttccagctgtcctgggccagacccaccccgggcctcctctctacagttcatcctgttcatcatctccattttcacctcttcccttgccacttggatcttattatcatttggctctgcatccgtcactttcacaaacctttcgctaaagagccagaatggatcccctgctttgaaaccaaggacaccaaggagtaggactccctgggaccaaattccactgatctggacctaaagggagcctcctctatgtggaaatgtctgaagtccgggactaagtgatggagtccctagatgatccaaaggcatcattttgatctccagacccaaactctctccccattaaactggcaaccagagctgctttttaaaaagaaccaaaggatgggtaaagaatcatttcccaccccccagaagaagtagagtgcaaatgagcactgcacagcctaaaggtagacagtaggttgaccctgaaatggcttcaggtagggggcttttaactcaccagactgggcgtctttgccttttgacggagtagcttaattttcccaaacagtgaattgcaggggtcgggctatgcaggggtggctccagcccaggcctcactgctgcctagttagcacctacagttgtcttggggcatggggcaccagctcagggtgctaggcccagggtgctcattagtgcctggtcacccacatccccaggtatctgcagggcatcccatgcccagcacaaagcctctgtgcttctcttcctctccttcatgggaggtggtgctgaatttccaaggcatggggtgggagggacacagatctttggaaaatagaaggtaaagcaacccatatctgaggcctaggtcagggatagatatcttatcacagtgtccttggcccaggactctaaaatgttcacatacagtcatgcacattcaccacaaaataggtacactgttgtcacacacaaacataaaacatgtaacgtgcaaaatacagacagaccaggttaacataaaagcaaacacagaagatatatggttataattgtatataaaatgcacactctgcacagatatagaatttacacagaacatacacaaaagacaaacatacaccacatacaaatatacaacctgaaactcagatgcaaaatacataaaaaactacatggacaaaatgcatatgcatataagatacacaaaggctactttaccattgtttctacacataaaatacacacaaactcagtatatacacacgatgcattaacttataataggcatacaagatacatagcacacatgcccaaaaatatcgcacaatacacatgaaatgcagacatatactcagacccattgccctgcccccagagctatgaattaacaggcacaaacaaaagatcagatgtaatcacctttgcctggcctgtgtctatatcccccaggatctttcaaggaatctctttctctattcttttctctcactaccagatttcactcctgagaagtaactcctaggtttcaagcaggaggatgggccaccacatcaagcagatatctgactaagaccaggaattgcatggggtctctaccaattcaccttcctcccaccagaaacctgggtgcagggtgtgaaagtacctgggacagctggtagcctaatataggcctccttgccatgacccttccttccttccagcaaatccgcacagacaacccaatagcccaggctccccttctcccagcacctgggatctccagattcagccctattctcttaaaagcagtaatggctcaagaaactgcaggatcttgagcccaggaccagggtaaagatgtccccaacattctctaagcccacagattttattgcccttccatcctttgcagctttgttgggggcacggtcaggaagttgagaccctatagagacctgtctcttaaaatgagccacctttacttgcttgtggcatttcacttgctcttgtgcataagcccaaaggggccaactcctgattcccctctgggtgtgttcaatcccgggcacgctcttccttttcctcttgttgggctcccctggatgccctgcctcccatccaattgctatgcaacccagttcagcttaagtaaaaagtgattaagaacatacatctaaggctaagcaagctaacactttttagagggcctgactttatcctatattctaaggccatatttaaatactttctaagattacccaccattttggattactcttggagctggttcttcccctaagtaggactagctgagagctgagtgcattttagcaaaggcttcacctacatcggaagtaaagagttgcagtcaggctttggatcaggcctcactcctgatttctgctcctgcagccatcccgttgtgtctcactctcccttccagtgatggtcgcagctcccagtctctacagaaaaggtaacaacagtagggagtggacatatgggtccaaaacgtgtgctttgctggaaacttgtgtttccaggtcaaggtaccattcctgttggcttcatcaagtgcctctgtggattcattttcaagaaacttggagttttcaggagaccgaaaaggaataggcccaggaaaggtggagagattgtcaggaagagagagtggctgagtgggtcaaatttcagagtaaactttttaggagccaacatttaattaagaaaataattaaggctctgtgctttctgaaacttcagtaatatttgacatgctctcttccttcttctctgcttgcctctgtccctctcacctgtgtttctgaggctagtgttggcatgtcaccatgaggttagccttttaaaaggggccccacgggagtgtgcctctagattgcgttagcctagtatggaaagggctcccatggaagctatgatggcctgagaccccagcctgggtgttcatgttgctgctccgtgttgggagggcccaggactagcttgttctacctattcttcctggatctctcactatattatagtgaggactctatcagtatcaacccatgtggagagaggacagcaccctctgaagctcctcaggctggggattcagcactgcccacagtagtagagtcacagaggctgactcccccctaaggaaactatagaacagtgtgcaaattgcatatgaaggtggcaccactacccctatgtcaggcaggggagcacagtgctttgacttgtttactcaagagaggggatgatggtgctgagctctgctccccagagctttcctggggcccattgtcataataacttgtatgtgggtgatggccgcctcatctgcgagggctataatatccatggtgctccttggttgcacaatggaggttcccctagccttggcaaggtatccattgccgggtttgaactcatgaccttaacctcattaacatcatcagtcacctgagccaacgcgcagagagggggatgctgggagctctctcagtagctattgtgaccatcatctatatcttcagacttagcccttgttgagtccaaccctgttcccctatcaaagcaaccagcagggacagatggaggtaggggctcccctacatgcaggaaggttctcttcctcaaactaacctagtttacttttcctttttttctgcttcccttcccaccaaatctcagcttcatctctcatagtttgtgtttgaatatttttaaagaggaaaagtgcaataaaataaatagtgactgttttctttagcaatagctctttcaaaatcttgctctcaggactgaaaagtgatagatagtacctggattatcagataatgcccttgacttctgggggctcattcacagtctctgtagtttcttcttcttcccacgtgttcacatgactcctgtcctcttgagatctgacctccttctggaatggacacatatgctaagatgcagtgtatgcacaaggaaggcctgtgagagggctttgtcactttgtctccttcctgtgtgcacctctctgtctccatgtgtgtctctgtcccctctccctctgtctccccatttctgcctgctgtcatacagcatccttacaacctctaggcatgaaaatcctaagtttgtgtgaccttttcagcccattttgttgactttccctcagtctggcagatgtaatggaagcctacacgaaagcacttcccaatagataagaataaagcatcctgagccattacagaagatcatttccatgcactaaaagccattacttgatccttttgcttccccttctcccttccccagggagacggatgctgagggaatgtggcctggaggtttgcacttgggatcagtagcctgggcagatttgggaattgccctctgactctctttcaaaataagctgacttgctcaaccaaagggactccgtgagagctgcagaaggaagcaggttcttgtgggtttcagtagaagtctacagggatagaagtttgggtggttagggcatgacattagtgaaataaagactctaccacccgctagagtgtgcagctgcacaaatatttgcacacatagccaggggcttcagaagagtcccctttcctaacatctgtgagcttaaatgttcagactggacaatcagggaaggctggcaaccccagggtcccattccatccttttttgatctaccttgctctatacacatatgtacagcaaaacctcagttaactgatggggaaacctcagggacaggaacatcctgattgctttgcaattttggttatttgagtgggaatgggaaagcatgtctggttcaacctttgttattgagaaaaatatttcctaagtaggttagcataactttcctgccttagttaagtagagtgtttgaagataacagggaccttgccttgctcagggtcaacattgtaaacctcaatgcttattgtacagtagtggacataggtagagaagaccaaagagacaggctgaatggctgctggctacaagacaggcctggaaatgggccactggggcacatcctggctcatcggagcccttgctgtcatttgcctctttctactgaaaggatagtaagaaaacataattcttgtcaatcgaggttttggttaattggtcctgagtttttagaggttttccatatatacatatatttatgtgtgtatatatatatatatagtatatgtatatatgtatactatttttaaattatagaattatacattgaccaatctccttagtttcacttatgtggaataaatttggcaatccaaggaataaactgcatttatgtgcattttttgaatgacctcctttgcattcttttcacctctccagttctactctttttttttctgcttagggacctctctagaaggcagatctttcataaaaaaagaacaggctacaggatcacctctttcctttccctcccaggtggctgcctgactcagggataaaagggaagtctgatctaacagccaggtgctttagcctttcttctgtctgccctggttggctataacctcatcactgaggatcagaaaagttattccaaactttgtactcgaggggagtggaaagcttgaagacctggcaaaggatttatctatttagcattctctttgtcattggtggtgccctaggtttgaggtttgtgagatctgaaagtaacattccaatgaagaactaaagcacatctctgccacacagaaggtgaggtttgtggcaatcaatggaactaacaaatccattctgttttttattatgactaaacctaagttgagggtgtgggtattagagcagctgaaattcagttgcctctttgggggtaagctgtacacatcactcaagaaacagctggatgcaagctaaaacctgctctcattctccctcttgcctgctagtgtgttagatccatggaagacagtttctctcagcctcacctcttgcatttgactgttgctttctacctagatgggagtgggagggatttttcactgtatctggagcaattgaagtggtgcaggggtgtctgccatctccccacacccacagaagccctccagtctggctatgttagttgtgatcaggcagcagaagcccataacccagacttgacatgaccagctggtgcactgaggcagttgaggtggcctgtctggatggctacttcttgtacttcatgaacctcagcatggaaatggatataactttctgtgctcctctgcactcctaaaatagtctaatatgttccagatgagtttgcagctgagaactccctgcatcattccactgatggatgcacagggcatgattatgtaataatgtggacagctactgcaacatctagatcattgagggcagtgtagatgtggctgtgtgctaggacccttggtagctatccagaggactcagtctggtgtctttctgagtctctgtgagaggcctctaagccctgcttctccttgaaaatgattccctagacaccgaatgccttgtttgtatgagtgaataaatgctctgggctgctagagaaagcaataggaggagctgggaggaagagaatattcaggggcgcactttgctaccaaacaatttccatgtcagctgctaacattactgcctttttagcctatgaagtgtagggcaaggactttgacctgccaggtggggctggaaaggagcacatcagctccaggctaagaaatgggatagaaaagcaagaagagaggcctggctggctttggcgggggtgagtctcagctcctgagggtttgaacatgctctgtgcttgccccagttctgccttcacgtgggatccagcgacccagtttccttttgttgtcgtgcttggatggttccttcatttgaagggccccaggaagctggaaagtcccatgatcaagctctagcctgctgagcaaacaataccccagccaaattggcctcttcctggttttctgcatccctgcacccctctctccactaaggataatcttggaacagttgcgattaatggtgccagcaatcaaggaagattctctagttttcatcagggacatagctgtaaagctcatgagtggaggatgctatttccttttccagacctgtgtgcttatgtgcttatataggctgcctctggagactttatattgtgtgtgatgtgtgtgtatatatatatacacacacatatatatatatatgtatatatatatatagagagagagagagagaggaaatggccgccactcacttaggctcatgcagcacagactccagttagggtttgcactggcttccttgctgcttgtgcatgaatcttcagctgccctcccatgtcctgtctctaataattgctgaaaactcaaagaggtagataaataagcctccttgggatcaatagcagaaggaactccaaggctgatggtaaagcttcgtaaggatgatgccgaaagggaactggggtctccatggtgataagaggctggggaccaatgagagctgaaggcggagcaggacttgcggggaagactcatgggagttgggagtcatttaactatttgtttgcttcttgaaaatttagacaccagctgtaactacattgcacaggatgtattgatattatcattcttgctgacatattctggaagctttcagccccaccaacactgccccacccaggacttctgcagctgagagttcctgtgtcagtagggtctgatatttgtacataggttatacatatatgtgtacatatgtgcctcaatgaacattgcctgtccacctgatcatgggtgtacatagacttcatagagctccacagtcttttgtaaatattgacacaagtaaataagtatataaatatatattactggggatttattttaacatcattctgtgtgatatgaaaaaaataaaatttttgacagaca

SEQ ID NO: 168286 - DNA, 2569 bp, Homo sapiens
  Payload ID: 13113
  Gene Symbol: KCNA3
  Gene Name: potassium channel, voltage gated shaker related subfamily A, member 3
  Uniprot ID: P22001
  ENST ID: ENST00000369769
  CDS Start-End: 225-1952
gcggaggcgggcgcgcgccccgcaggggagggggcggagagcgcgagaaggagggaggaggcgtccccgtgcgggagcccggctgaccgcgccagacccagacagagcatcgcggctttggctgcaacaggcggtgggctcggctcgggggcggaggcggcgaaagggcggggagcgcgaggaggagcgacctggcctcaccgctgccgcctcttccccgccgcatggacgagcgcctcagccttctgcgctcgccgccgccgccctcagcccgccaccgcgcccaccctcctcagcgcccagcgagcagcggcggtgcccacacgctggtgaaccacggctacgcggagcccgccgcaggccgcgagctgccgcccgacatgaccgtggtgcccggggaccacctgctggagccggaggtggccgatggtggaggggccccgcctcaaggcggctgtggcggcggcggctgcgaccgctacgagccgctgccgccctcactgccggccgcgggcgagcaggactgctgcggggagcgcgtggtcatcaacatctccgggctgcgcttcgagacgcagctgaagaccctttgccagttccccgagacgctgctgggcgaccccaagcggcgcatgaggtacttcgacccgctccgcaacgagtacttcttcgaccgcaaccggcccagcttcgacgccatcctctactactatcagtccgggggccgcatccgccggccggtcaacgtgcccatcgacattttctccgaggagatccgcttctaccagctgggcgaggaggccatggagaagttccgcgaggacgagggcttcctgcgggaggaggagcggcccttgccccgccgcgacttccagcgccaggtgtggctgctcttcgagtaccccgagagctccgggccggcccggggcatcgccatcgtgtccgtgctggtcatcctcatctccattgtcatcttctgcctggagacgctgccggagttccgcgacgagaaggactaccccgcctcgacgtcgcaggactcattcgaagcagccggcaacagcacgtcggggtcccgcgcaggagcctccagcttctccgatcccttcttcgtggtggagacgctgtgcatcatctggttctccttcgaactgctggtgcggttcttcgcttgtcctagcaaagccaccttctcgcgaaacatcatgaacctgatcgacattgtggccatcattccttattttatcactctgggtaccgagctggccgaacgacagggcaatggacagcaggccatgtctctggccatcctgagggtcatccgcctggtaagggtcttccgcatcttcaagctgtcgcgccactccaaggggctgcagatcctcgggcaaacgctgaaggcgtccatgcgggagctgggattgctcatcttcttcctctttattggggtcatccttttctccagcgcggtctactttgccgaggcagacgaccccacttcaggtttcagcagcatcccggatgccttctggtgggcagtggtaaccatgacaacagtgggttacggcgatatgcacccagtgaccatagggggcaagattgtgggatctctctgtgccatcgccggtgtcttgaccatcgcattgccagttcccgtgattgtttccaacttcaattacttctaccaccgggagacagaaggggaagagcaatcccagtacatgcacgtgggaagttgccagcacctctcctcttcagccgaggagctccgaaaagcaaggagtaactcgactctgagtaagtcggagtatatggtgatcgaagaggggggtatgaaccatagcgctttcccccagacccctttcaaaacgggcaattccactgccacctgcaccacgaacaataatcccaactcttgtgtcaacatcaaaaagatattcaccgatgtttaatatgtgatacaagtgacatgctgtgctcagtattgtgtggaacgtgcccccttggtctgcctatgcccttgttttatacatttccagaccattcatcaaggaaaggacctgaagaagtggaaagcacacttcattctccctctccctgctgcttcatactgaaacaggtgcctgttttgcaagtgggctgcattctctcagctctccttttccctcttaccctctctctcttaacattgtaaacaacagacttacgttaaacttcatttctagtacacgccctatttaaaaaagagcagtacatcctgggaggaaatgaaactaaagaacagttagagtaactgtttaacctcagaattttaaaggcagttgtttctttcctaagcacatcaattcgtagtaaatgatgcttcggtttgatggacctttcaacgttatttattgaatatgtatttcggttgcctaccctgtagatatgtggatgaagagtctaactagaataatgacttgtaaacccaccatgagttatttggtttttgacttaaattcctatttgaatcccctttcccggaattttaagtgtctctacaactttgaataaagggaaatgcccaaga

SEQ ID NO: 168287 - DNA, 4172 bp, Homo sapiens
  Payload ID: 13114
  Gene Symbol: KCNA4
  Gene Name: potassium channel, voltage gated shaker related subfamily A, member 4
  Uniprot ID: P22459
  ENST ID: ENST00000328224
  CDS Start-End: 1235-3196
gttcgcggccaggggaggcgtgtgctgctcccgcagccagcgagagcgagagagggatggatgttggaggaggaattcgggcttaacaagtgatcgctgctgtctaggattttgtttcttttcgggggaaccttgacttcctttcccaggcaatccctcctgtgctgaactccagaggaaccaggagtcttggggtcttctctggggcagccccaacccccacccccaggctccagccgcgaggactctgtgcacccctcgggccaggcaacagaacttgttccgtggatatttggagcctccacctgccaaacccgagtgattccttttaccaccccccgccccccacccaggatcattcttcccctcctccagctgttgcagcttgagggggaaaaacaagccagccggtggattttctttatttttatttttcgccccgccggggaacggtgaagtgcttcttctgcatgattttggctgaagaatgctctgcatttccttgatttctatggagacctcagagctggttttgcttctgctgacacctcatctagcaccttctctacctcccagggtctttgcctctatctgtggtttggcattgtacctgggtacaggaagcctttgatgaacttaaaaggagagcctggagaatcatcctgatagactttgagtagaaatggctggacatacttcaaaccacatcttaacatggttcgagccatcactagaaggcaagtgctaacagtaaaggcttatttgcattttatttacatttaatggactgagcattggccaatttccatggcagaaaaatatatttcattttctaggcacaacttctggctgtcagacacttgctgcctttgaatcttgcagcaacatcactaaccacatcccagacatatttccaaatttcaacatctacccccaaaacataggtgtctgagagactccagcattttcggacttcttagtcttgagagtgccaggctatttatctcgaccagccaagctctggagagcaatgttgaatccctgagaagagagagcatggggcgtgctgatttaaaaacagaaaatgcaaagttggactgaaaatatccttagtcttccaagcaatctgcttaagggttccaaacttaccttaatttggtgagaaaagaagctgccctatttttctttcttcttcttctacaactggaaccagccatttccgaaaaccaccaccatggaggttgcaatggtgagtgcggagagctcagggtgcaacagtcacatgccttatggttatgctgcccaggcccgggcccgggagcgggagaggcttgctcactccagggcagctgcagcagctgctgttgcagcggccacagctgctgtcgaaggtagcgggggttctggtgggggctcccaccaccaccaccagtcacgcggggcctgtacctcccatgaccctcagagcagccggggtagtcggaggaggaggcgacagcggtctgagaagaagaaagcccactaccggcagagcagcttccctcattgctctgacctgatgcccagtggctctgaggagaagatcctgagggagctgagtgaggaggaggaagatgaggaggaggaggaagaggaggaagaggagggaaggttttactatagtgaagatgaccatggtgatgagtgttcctacacggatctgctgcctcaggatgagggcggtggcggctacagttcagtccgctacagtgactgttgtgaacgtgtggtgataaatgtgtcaggcctacgctttgagacccaaatgaaaactctggcccagtttccagagactttgttgggagaccctgaaaagaggactcagtactttgaccctttgcgcaatgagtatttttttgacaggaaccgccccagctttgatgccatcttgtattattatcaatcaggaggccgcctgaagaggccagtcaatgtcccctttgatatcttcactgaggaggtgaagttctatcagttgggggaggaggccctgttgaagtttcgggaggacgagggctttgtgagagaagaggaagacagggccctccccgagaatgaatttaaaaagcagatttggctcctctttgaatatccagagagctccagtcctgcaaggggcatagccattgtgtccgtcctggtcatcttaatctccattgtcatcttttgcctggaaaccttgcctgagtttagggacgacagggatctcgtcatggcactgagtgctggcgggcatggtgggttgttgaatgatacttcagcaccccatctggagaactcagggcacacaatattcaatgaccccttcttcatcgtggaaacagtctgtattgtatggttttcctttgagtttgtggttcgctgctttgcttgtcccagccaagcactcttcttcaaaaacatcatgaacatcattgacattgtctccattttgccttacttcatcacactgggcactgacctggcccagcaacaggggggtggcaatggtcagcagcagcaggccatgtcctttgccatcctcagaatcattcgtctggtccgagtattccggatcttcaaactctccaggcactccaaaggcctgcagatcctgggccacaccctcagagccagcatgcgggaactgggccttctgatcttcttcctcttcattggggtcatcctcttttctagtgctgtgtattttgcagaggcggatgaacctactacccatttccaaagcatcccagatgcattttggtgggctgtggtgaccatgacaactgtgggctatggggacatgaagcccatcactgtagggggcaagattgtcgggtccctgtgtgccattgcgggtgtcttaaccattgctttgccagtgccagtgattgtctctaactttaactatttctaccacagagagactgaaaatgaggaacagacacagctaacgcagaatgcagtcagttgtccatacctcccctctaatttgctcaagaaatttcggagctctacttcttcttccctgggggacaagtcagagtatctagagatggaagaaggagttaaggaatctctgtgtgcaaaggaggagaagtgtcagggaaagggggatgacagtgagacagataaaaacaactgttctaatgcaaaggctgtggagactgatgtgtgaatctttttccacctgccactgctcccccctcagcatctccaaatatatttatgcatagagagtgcagttatgaaaatgaaatatgcaaatgatccaatgcatacagtagtacactatttaatggttatacatggcataattgttactaaacttgtattacatatcaaataaatgatacatcttggagaagagggaggaataggagcaaatctatctttatatttttattagaatgcaagaattttgcacattaactggaaaagatgttaacagtaaagatggagagagagagtgtgtgcgtgtgtgtgtatatgtgtgtgtgtgtgaagtaaattgtcaatgttagtaattgtgcagtgaagggaaaagttggcattttgaagtatttactatgtaagaactaatgaatctgagcagtcatttatcagtgctttaacagcatatcgtatgtctttggattctgtagttgttttttaaaaattgtaagaaatactgtgtagagaaaaaagaaagtaaattatttaatagactataggtcacaattttatcttggatttaattaaaatttatttttaactggaaattaacttttaaaaaggctgcaagggcctttagaaattgattatattttgttattaattttgggaagacttaacagcaaatgtctaacattatagaataagtgaaattggagaatatgtaataagttttgtttgcaggtaacaggactggatttttttttctttgcactactttatatgctggagattgagagagacttcaaactgtgaatgtttactaatgtaacagttcaatgacaatcattggaagaatgatttctttagtcttattttattgttttcttttcattgtgtgagactaatgatcatgcagataacatcacaggattctctcctcttttaaaatctaaataactgattgacaaaggaattatgaagtaaaatttagcaactga

SEQ ID NO: 168288 - DNA, 2800 bp, Homo sapiens
  Payload ID: 13115
  Gene Symbol: KCNA5
  Gene Name: potassium channel, voltage gated shaker related subfamily A, member 5
  Uniprot ID: P22460
  ENST ID: ENST00000252321
  CDS Start-End: 160-2001
cagggccaagcgaggggatcgcgccagcaaccccagctctccccagagaggggccggccgaccgctggagcggagcctgacgccaggcgcccgcggagcgtgagtagggggcgcgggagccggtcagctggggcgcagcatgccctctgctcccgcgccatggagatcgccctggtgcccctggagaacggcggtgccatgaccgtcagaggaggcgatgaggcccgggcaggctgcggccaggccacagggggagagctccagtgtcccccgacggctgggctcagcgatgggcccaaggagccggcgccaaaggggcgcggcgcgcagagagacgcggactcgggagtgcggcccttgcctccgctgccggacccgggagtgcggcccttgcctccgctgccagaggagctgccacggcctcgacggccgcctcccgaggacgaggaggaagaaggcgatcccggcctgggcacggtggaggaccaggctctgggcacggcgtccctgcaccaccagcgcgtccacatcaacatctccgggctgcgctttgagacgcagctgggcaccctggcgcagttccccaacacactcctgggggaccccgccaagcgcctgcgctacttcgaccccctgaggaacgagtacttcttcgaccgcaaccggcccagcttcgacggtatcctctactactaccagtccgggggccgcctgcggaggccggtcaacgtctccctggacgtgttcgcggacgagatacgcttctaccagctgggggacgaggccatggagcgcttccgcgaggatgagggcttcattaaagaagaggagaagcccctgccccgcaacgagttccagcgccaggtgtggcttatcttcgagtatccggagagctctgggtccgcgcgggccatcgccatcgtctcggtcttggttatcctcatctccatcatcaccttctgcttggagaccctgcctgagttcagggatgaacgtgagctgctccgccaccctccggcgccccaccagcctcccgcgcccgcccctggggccaacggcagcggggtcatggccccgccctctggccctacggtggcaccgctcctgcccaggaccctggccgaccccttcttcatcgtggagaccacgtgcgtcatctggttcaccttcgagctgctcgtgcgcttcttcgcctgccccagcaaggcagggttctcccggaacatcatgaacatcatcgatgtggtggccatcttcccctacttcatcaccctgggcaccgaactggcagagcagcagccagggggtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacaaccagggaacccatttctctagcatccctgacgccttctggtgggcagtggtcaccatgaccactgtgggctacggggacatgaggcccatcactgttgggggcaagatcgtgggctcgctgtgtgccatcgccggggtcctcaccattgccctgcctgtgcccgtcatcgtctccaacttcaactacttctaccaccgggaaacggatcacgaggagccggcagtccttaaggaagagcagggcactcagagccaggggccggggctggacagaggagtccagcggaaggtcagcgggagcaggggatccttctgcaaggctggggggaccctggagaatgcagacagtgcccgaaggggcagctgccccctagagaagtgtaacgtcaaggccaagagcaacgtggacttgcggaggtccctttatgccctctgcctggacaccagccgggaaacagatttgtgaaaggagattcaggcagactggtggcagtggagtagggaatgggaggcttgctgaacatggatatctacattataccgcagagtatttgaagtcacactgtaacctcagtctacccctctcctttcactcctttcctccctccctcgatccccccattttctctattctttccatgacacccaagggtcgcctatttttaaaaagtaccacattccatgacgcaggagctgtggaaatggtgagcgctgtgagatggatgtatttgtagccagtctcctatacccagcagagggataacccaaacaaaaatgactctaaatagcccagatcccaagagattatgtaactcctccatccatgtgttccaaatttgctttacatatgattgtatttgtgtataggggaaaatattatttttatgcctggtaagtggctttttgtactgtagttcagatagagatattttgggtatattttcaagatacatgttgtatttatggaagaaagagttgtcctgatgtttttctgtgttacttatattagagtcagagatcttggtatgggctgttctgtttcctgtgtctccaagcctctgtcttttctgggatgtggtattggtgctttgtgtctagggcagagtatgttcttgaagaaaggcaaatctgactttttctgtgcgccttaaacaattcttgtaactttcttcaaaaagcattttaatgatattggaggaatacttctgataatttattgtctttatttttatcccaggaaataaaaggttaccttgttgaggcaa

SEQ ID NO: 168289 - DNA, 4372 bp, Homo sapiens
  Payload ID: 13116
  Gene Symbol: KCNA7
  Gene Name: potassium channel, voltage gated shaker related subfamily A, member 7
  Uniprot ID: Q96RP8
  ENST ID: ENST00000221444
  CDS Start-End: 357-1727
aaacttggagagacgcaggacaggatcccggcggcagaaggacggagagaaaggggaccccgggacgggaaaggcgcagagcaggcgcgggcggcggcggcggcggggcagggcagggcgggcgtcccggcagagggcgcgcggtcgccctgtcgccctccgccccgccggggtcacagtgccccctccctcgcgccctagccgccctgccgggctatttttacgcgcggacaccggacaccggacaccgggctggggcggcggcggcggcggccgaggcggccgaggcggggccgcaccggggccgggcgtcggggccacacgtcggttcgcgggtcgccggggctgcgcgcgccatggagccgcggtgcccgccgccgtgcggctgctgcgagcggctggtgctcaacgtggccgggctgcgcttcgagacgcgggcgcgcacgctgggccgcttcccggacactctgctaggggacccagcgcgccgcggccgcttctacgacgacgcgcgccgcgagtatttcttcgaccggcaccggcccagcttcgacgccgtgctctactactaccagtccggtgggcggctgcggcggccggcgcacgtgccgctcgacgtcttcctggaagaggtggccttctacgggctgggcgcggcggccctggcacgcctgcgcgaggacgagggctgcccggtgccgcccgagcgccccctgccccgccgcgccttcgcccgccagctgtggctgcttttcgagtttcccgagagctctcaggccgcgcgcgtgctcgccgtagtctccgtgctggtcatcctcgtctccatcgtcgtcttctgcctcgagacgctgcctgacttccgcgacgaccgcgacggcacggggcttgctgctgcagccgcagccggcccgttccccgctccgctgaatggctccagccaaatgcctggaaatccaccccgcctgcccttcaatgacccgttcttcgtggtggagacgctgtgtatttgttggttctcctttgagctgctggtacgcctcctggtctgtccaagcaaggctatcttcttcaagaacgtgatgaacctcatcgattttgtggctatccttccctactttgtggcactgggcaccgagctggcccggcagcgaggggtgggccagcaggccatgtcactggccatcctgagagtcatccgattggtgcgtgtcttccgcatcttcaagctgtcccggcactcaaagggcctgcaaatcttgggccagacgcttcgggcctccatgcgtgagctgggcctcctcatctttttcctcttcatcggtgtggtcctcttttccagcgccgtctactttgccgaagttgaccgggtggactcccatttcactagcatccctgagtccttctggtgggcggtagtcaccatgactacagttggctatggagacatggcacccgtcactgtgggtggcaagatagtgggctctctgtgtgccattgcgggcgtgctgactatttccctgccagtgcccgtcattgtctccaatttcagctacttttatcaccgggagacagagggcgaagaggctgggatgttcagccatgtggacatgcagccttgtggcccactggagggcaaggccaatggggggctggtggacggggaggtacctgagctaccacctccactctgggcacccccagggaaacacctggtcaccgaagtgtgaggaacagttgaggtctgcaggacctcacacctccctagagggagggagggagggcagggtggagggcaaggctggggggaggggattgggtttaggaagagctaggttaagtcgtaacgagtggggaaacactgagtcttgttgggtcttgggttgtgtggtttggtagctcctgtgggtacctcctgaagcagcagcgaatggcaatgggttgtgttgtgttaatgaagactcaattggttcatattactctgagttgtgcaaagctcatggagccttttggggtagtgttgagataggtttggtcgtatcattttgtgagtttcctaggtcagtgttgggtttggttgggttgtgagtctgggatagtgtggtccagctgcattgtgtaggattctgtggtttggtgggtcccctagggccatgttgggtcaagttagatggtcccccatggcattgttgagatcgaatgtgtgtggtgttaagtttcgttgagacatggtggaaattgtgtagctctgtgattcttccaggggcatgttattttaggttctgtgaacttgcgagtcatgtagaaatgtgaagagtccagtggtagaatttgagctttctaggtcacattgggttaagtttgtatgaccaaatgaatcttgtagggttctgttgggcttaactgtgtagaggtgtgtggctggacatttttcgtggccacagcgagttgagttgtgttgaattgtacaaccatatgagccttgtaaggccagttcagttgggtcatgccactgtttgagtctcatagggccatgctgaattgagttccattgagttgtgtcactatgtgagtcctacaggaagttgggttgagttggactgtgcgaacgagttccatagggccacatcgggctgttttgcatttagtggtagcaccaggacccaaaggaaatagcagtggggaagcatcatgtatctgggagcatgcagtggcgagggctctgggaggtgtgccgagctggctccccagctcgctgtagggggcgggactggattctgtatccatgggattgggtgttcatccagaggcgactgggtaaattaggaagaggtggatgctcctcctgtttaccccacatccacttcattgtgctgttcactcccattctcccctacagttttatgctcagacatggaggtcagagccacaagggaaaggggagagggggagaaaactgtactctgtccagacatgatagagggacagagccaaaaggatagagaaagagacccagaaaaaggaagaggtggaaacccagagagacagagacccaaagggagagaaacagagactcagggagagggagacaatgacctggagggtggggtatggcagagacgcagaagagaggaacagaaatccagagtggggagacagagaccaagagcaggggatagaagccgggcgaagtggcccatgcctgtaatctcagcactctgggagaccgaggaagggggattgattgaggccaggagttcaagaccagcctgggcaacatggtgagaccccatctctacaaaaaatacaaaaattagctgagtgtggtggcacatgcctgtgatcccagctactcaggaagctgaggcagaaagatcccttgaccctgagaggtagaggctgcattgagccatgattgcaccactgcactccagcctgggcaacagagggagcccccgtctcaacaaacaaacaaaaagagccagtgggggagggagggacagagacccagagggcagcgtcagacacccagagttggagacagaacaacagagtctcagggaaagagaaccacaatagaaaaaggcagaaaaggccgggcgcggtggctcatgcctgtaaccccagcactttgggaggccgaggtgggcaaattacgaggtcaggagatccagaccatcctggctaacacggtgaaaccccgtctctactaaaaatacaaaaaaattagccgggtgcggtggcgggcacctgtagtcccagctactcgggaggctgaggcaggagaatggcatgaacctgggaggcggagcttgcagtgagccgagattgcgccactgcactccagcctgggcagcagagcaacactctgtctcaaaaaaaaaaagaaaagaaaagaaaaagccagaaaaagttggtgcccctgaacccaagagtgatgtacagtctattccatagaatcacagaacaatcctgaaccaggcctgtcacctaccctccctgcagctcaggaaggctgtcagacaggctgggggcctcactctgttttccaggggagaaacctgagtctcagagcaggggagtggcttcccaaggtctcacagcttgtccccaggggccaggcaggctgtctgtctgcttcacatgtccccatcagcctgctgggacacacgggtcctcctgagtcccgtagcctcatttcttacagacggggaaactgaggctcagagcagcaggtgttacccaaggtcacaaggccgaacattttcagaaatctttcagaactcaaagggcatttagaggaagaaggctgaaatcactaacacatatagggcttcctttggtatcaaagtactttacttgggttaatttatta

SEQ ID NO: 168290 - DNA, 4437 bp, Homo sapiens
  Payload ID: 13117
  Gene Symbol: KCND1
  Gene Name: potassium channel, voltage gated Shal related subfamily D, member 1
  Uniprot ID: Q9NSA2
  ENST ID: ENST00000218176
  CDS Start-End: 1299-3242
tgccaccttctctcctatgcctggctgtggttgcttctcttcctcctgctgccgctgctgctactgccactgcccagtacacaccgccagcccctcggggtgtggtttccccagacctgcccccaacggtgggacccagccttctcccggcgtctcctgccagcttcctgcaaagcccaggagcccccctccctggagacacacccaactccctttcaacaccccacccccctcttaatcccattttggggttaacccccttcctcttatttagtcttcatagatcccctgggtgctctgggattgtgcccaacttcctaacatttgagtcccggcccttggaattccccaggcccctttttcctccctgtagaactcctgagagtgtcgaccaggctttgttggcccgtctagatacccacctcccccagataactctcagcctctcaaaaaataacccagccccctgtctacccctttagataaccccttcccctctccagccctactaggaggctctggcctctcctttcttccccagaactcctgtagagtatagacacccccccgggctattcttggcaactctaggcagtcccaagacacctttcagcctctttacaacctcctggatccacagccacccctcaagatgcaccagctccctttccagatccatgaggggggtctaaccctcttatgcttcccctagaagtcttgagggtgtggacaaccctcctcacctgtctcagcccctctagaacccccacttccaggcactctcagtctctttcaagcacctctggtcccatttctacccctctggatgccccagtctcctctccaccactgcaaaggaattccaggctcttctgccttccctgagactcttgagagtgcagagaattccccacgtgtttcttggcccctctagacgcccccagacacctctcaggcacaggctgactcctttagaatcatctcagtctctctaaaccctccctcagctccttcttggccccatccccacaccccttttctgctcttctccatgtccccaaggcccttctcagtccctcagaacattgcccaggcccctcctaggttctgtaaatgtcccccagactccttcccatctctttagttcttcctcctggttcctcttggcctctctagacacccccagtttccttgtttgggtggctcaaggtgtctccaagcccccaccatcctggagacagccacattctcctaaacgccaccctcactaagtctccctgggcttggggagtggcacgatggcggcaggcctggccacgtggctgccttttgctcgggcagcagcagtgggctggctgcccctggcccagcaacccctgcccccggcaccgggggtgaaggcatctcgaggagatgaggttctggtggtgaacgtgagcggacggcgctttgagacttggaagaatacgctggaccgctacccagacaccttgctgggcagctcggagaaggaattcttctacgatgctgactcaggcgagtacttcttcgatcgcgaccctgacatgttccgccatgtgctgaacttctaccgaacggggcggctgcattgcccacggcaggagtgcatccaggccttcgacgaagagctggctttctacggcctggttcccgagctagtcggtgactgctgccttgaagagtatcgggaccgaaagaaggagaatgccgagcgcctggcagaggatgaggaggcagagcaggccggggacggcccagccctgccagcaggcagctccctgcggcagcggctctggcgggccttcgagaatccacacacgagcaccgcagccctcgttttctactatgtgaccggcttcttcatcgccgtgtcggtcatcgccaatgtggtggagaccatcccatgccgcggctctgcacgcaggtcctcaagggagcagccctgtggcgaacgcttcccacaggcctttttctgcatggacacagcctgtgtactcatattcacaggtgaatacctcctgcggctgtttgccgcccccagccgttgccgcttcctgcggagtgtcatgagcctcatcgacgtggtggccatcctgccctactacattgggcttttggtgcccaagaacgacgatgtctctggcgcctttgtcaccctgcgtgtgttccgggtgtttcgcatcttcaagttctccaggcactcacagggcttgaggattctgggctacacactcaagagctgtgcctctgagctgggctttctcctcttttccctaaccatggccatcatcatctttgccactgtcatgttttatgctgagaagggcacaaacaagaccaactttacaagcatccctgcggccttctggtataccattgtcaccatgaccacgcttggctacggagacatggtgcccagcaccattgctggcaagattttcgggtccatctgctcactcagtggcgtcttggtcattgccctgcctgtgccagtcattgtgtccaactttagccgcatctaccaccagaaccagcgggctgacaagcgccgagcacagcagaaggtgcgcttggcaaggatccgattggcaaagagtggtaccaccaatgccttcctgcagtacaagcagaatgggggccttgaggacagcggcagtggcgaggaacaggctctttgtgtcaggaaccgttctgcctttgaacagcaacatcaccacttgctgcactgtctagagaagacaacgtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatgctggcagggctgcgcaggagccatgcccctcagagccgttccagcctcaatgccaagccccatgacagccttgacctgaactgcgacagccgggacttcgtggctgccattatcagcatccctacccctcctgccaacaccccagatgagagccaaccttcctcccctggcggcggtggcagggccggcagcaccctcaggaactccagcctgggtaccccttgcctcttccccgagactgtcaagatctcatccctgtgaggggtaggcctgctgattcagagggtcctcttcatttttgggaactcctttccaaagccatatttttgggaggcagagaggggcaggcttgggcaccccttctgccccccccactgagaactatgcaatggagtttcatgaaatggtccacatagtggggaagtagccaggaaatgagaaacttcctcccaccccagacatttttcctggtgggagctgaagcactgggcttccacaggcccctggcctccttgccctagcacactgggactggccccactctcccagctggactcctgcatgctcctccccttgggctctcagatgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggag

SEQ ID NO: 168291 - DNA, 3306 bp, Homo sapiens
  Payload ID: 13117
  Gene Symbol: KCND1
  Gene Name: potassium channel, voltage gated Shal related subfamily D, member 1
  Uniprot ID: Q9NSA2
  ENST ID: ENST00000376477
  CDS Start-End: 1291-2103
ccttgatgtttcccagaacaagatgttttcagcatttttattattattatttttttgtcgatccctgcagaagaaacagagttgggataaaagtatcaaatggaatcatcgaactcatgagctttccaaagatactgtctagggcagatgctgtgatccttctctaagtttccatcactgggattgggtatacagttggtgctcagtatctgttgaaggaatgactgaatgaattgggtttgctcagtttcttcatagaggtacaaaaaaaagttgatttggggtttctaaagcgtagaaaccccaattctggttggaggtccaggatcagactgacaaacaaatactgagcgctgacagtgggctggaactgagtattttgatggcttttactctattcaagtcctcacaacaactctgtgatggtggatggctgcccatgtctcacagttgaggacacgctctgagatgacacatcacagagccagcaatggccaagttggaaagacttttgagcagagtcctgaatgcttaaaatgagtgaaaataccgaaataaggaacagccatcctagggcacagcctgagaaaaggcttagaggctgaagactgcagaggctgtgtttctctggaggagttctgattggttctgcggtcagaacaagagtatgcagtgtgatcttgggcgagtcagttacagaatctccctgatcttcaggggagctctctgtgaacaagttagtaaggttggctctgctctgtctctgtgggaggtgggtggcatggagaaaggcaggagggtttcaaggctcctccctgttttgtcatatgtggacagttttcaaggattcccctataggggaatgaaaaggggtcctacctagagcaggtaagacagaggcagccaaaaccaacaaaacactcctcccgggacttgaagcccttcggctggcctgtggtgctgggactctctccccaggaggctgtgttcactgcctgtgacttcctcatgctcccctctgcttggttttcatagatttctagctgactcaggtgcttggtatgtagcttggacaggggcagcagatggtaggggttgagggccaggcccatttctcacttggccacccagcattttacagagcaagaaactgagggactcagaaggtttgagtgcctggccagggtcacagagctagtccggattagatgggatggagtgggggactgaaaggtaggtgggcacttttcctgaccttggcctacctcccctcgctccagctacggagacatggtgcccagcaccattgctggcaagattttcgggtccatctgctcactcagtggcgtcttggtcattgccctgcctgtgccagtcattgtgtccaactttagccgcatctaccaccagaaccagcgggctgacaagcgccgagcacagcagaaggtgcgcttggcaaggatccgattggcaaagagtggtaccaccaatgccttcctgcagtacaagcagaatgggggccttgaggacagcggcagtggcgaggaacaggctctttgtgtcaggaaccgttctgcctttgaacagcaacatcaccacttgctgcactgtctagagaagacaacgtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatgctggcagggctgcgcaggagccatgcccctcagagccgttccagcctcaatgccaagccccatgacagccttgacctgaactgcgacagccgggacttcgtggctgccattatcagcatccctacccctcctgccaacaccccagatgagagccaaccttcctcccctggcggcggtggcagggccggcagcaccctcaggaactccagcctgggtaccccttgcctcttccccgagactgtcaagatctcatccctgtgaggggtaggcctgctgattcagagggtcctcttcatttttgggaactcctttccaaagccatatttttgggaggcagagaggggcaggcttgggcaccccttctgccccccccactgagaactatgcaatggagtttcatgaaatggtccacatagtggggaagtagccaggaaatgagaaacttcctcccaccccagacatttttcctggtgggagctgaagcactgggcttccacaggcccctggcctccttgccctagcacactgggactggccccactctcccagctggactcctgcatgctcctccccttgggctctcagatgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggagagatgagg

SEQ ID NO: 168292 - DNA, 397 bp, Homo sapiens
  Payload ID: 13117
  Gene Symbol: KCND1
  Gene Name: potassium channel, voltage gated Shal related subfamily D, member 1
  ENST ID: ENST00000419374
  CDS Start-End: 1-397
gggtcggggcctggatagggttggggtgagccataacggggaggaaggtgctgcccttatcgctctgctccatctactccaggacagcggcagtggcgaggaacaggctctttgtgtcaggaaccgttctgcctttgaacagcaacatcaccacttgctgcactgtctagagaagacaacgtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatg

SEQ ID NO: 168293 - DNA, 5331 bp, Homo sapiens
  Payload ID: 13118
  Gene Symbol: KCND2
  Gene Name: potassium channel, voltage gated Shal related subfamily D, member 2
  Uniprot ID: Q9NZV8
  ENST ID: ENST00000331113
  CDS Start-End: 966-2858
cggctgctcgcgagctgctttctctcctcttccctttccgggtgcacggcgaggagaaagtctctatgcaactaagccccggcgcgcacttggccaggtatgtaccgcgggagcggcgcgttctgcgcggaagcagatgctgctgccgccacggcggcggcggctgccagctcctgagctctgtaactgtcacactgcacctgagctgaacttgaaaagagagtgaaggggcgattgggcgaacgcttttggcagacacagagggtgtttgtagacgtgggggaggagaatctctattaacgccccccaccgtaaccactgcacatcacctccatctctgcaaatacagcccgaggagtagaggcagcagcagctggacccccaaagagagacgtggggcagcggctgtgaccgcatctcctgagctacaacaacaggtcgcctttttgagactcctttggcgggaagggctacttggaaaggaaggtttgaaagagtgagaagggtaggtgtaagggttccctaattcgtcgaaagaattctattgggtgactctcgttcgtcttctctatcctacactccacatactgaccctatattatccagactgtgccggggagaaatcaaaaacacctgtttgaagaaacggctgcacctgtgtgcttatttgtgccagagggtggcctagcccacctgcaggaagagatttggctgggttctgttgagggtgattgttaggacgttgtattttgttgccattattccaaatacctgtcttggagggaaagttgcccttctgagaactgtgactttaccaggagccctatcttggaataagagttacacctctggaccacgtttctcactagtactttgcttgactggaggaagtgggtgacttttggctgcttcggtgacccattgtagacgcctcgttacccttcttccttccgcttcaagtaatcatggcggcgggggtggcagcgtggctgccttttgcaagggcagcggctatcgggtggatgcctgtggcctcggggcctatgccggctcccccgaggcaggagaggaaaaggacccaagatgctctcattgtgctgaatgtgagtggcacccgcttccagacgtggcaggacaccctggaacgttacccagacactctactgggcagttctgagagggactttttctaccacccagaaactcagcagtatttctttgaccgtgacccagacatcttccgccacatcctgaatttctaccgcactgggaagctccactatcctcgccacgagtgcatctctgcttacgatgaagaactggccttctttggcctcatcccggaaatcatcggcgactgctgttatgaggagtacaaggatcgcaggcgagagaacgccgagcgcctgcaggacgacgcggataccgacaccgctggggagagcgccttgcccaccatgactgcaaggcagagggtctggagggccttcgagaacccccacaccagcacgatggccctggtgttctactatgtcacggggtttttcattgccgtctctgtcatcgcgaatgtggtggaaacagtgccgtgcggatcaagcccaggtcacattaaagaactgccctgtggagagcggtatgctgtggccttcttctgcttggacacggcctgcgtcatgatcttcacagttgagtatttgcttcgcctggctgcagcgcctagtcgttaccgttttgtgcgtagtgtcatgagtatcatcgacgtggtggccatcctgccttattacattgggctggtgatgacagacaatgaggacgtcagcggagcctttgtcacactccgagtcttccgggtcttcaggatctttaagttttcccgccactctcaaggcctgcgcatcctggggtacacactgaagagttgtgcctcagaattgggcttcttgcttttctcgctcaccatggctatcatcatcttcgctacagttatgttctacgcagagaaggggtcttcggctagcaagttcaccagcatccctgcagccttctggtataccatcgtcaccatgacaacactagggtatggtgacatggtgccaaaaaccatagcagggaagatttttggttctatctgttcgctgagtggggtcttggtcattgctctacctgttccggtgattgtatccaacttcagtcgcatctaccaccagaatcaacgagcagacaaacgaagggcacaaaagaaagctagactggccaggatccgggcagccaaaagcggaagcgcaaatgcttacatgcagagcaaacggaatggtttactcagtaatcagctgcagtcctcagaggatgagcaggcttttgttagcaaatccggctccagctttgaaacccagcaccaccacctgcttcactgcctggaaaaaaccacgaatcacgagtttgtggacgaacaagtctttgaagaaagctgcatggaagttgcaactgttaatcgtccttcaagtcacagtccttcactgtcttcacaacaaggagtcaccagcacctgctgttcacgacgacacaaaaaaacttttcgcatcccaaatgccaatgtatcaggaagccatcaaggtagtatacaagaactcagcacgattcagatcagatgtgtggagagaacacctctgtctaacagccgatccagtttaaatgccaaaatggaagagtgtgttaaactaaactgtgaacaaccttatgtgactacagcaataataagcatcccaacacctccagtaaccacaccagaaggagacgataggccagaatcccctgagtactcaggaggaaatattgtcagagtttctgctttgtaagacaattggaataaggtctaagagaattcgagccctggctgtgaaaagaatctcaacatagaagaaagaagaaacaataaatattctgcagattaatgcagcaaagaaagaaggttggtagtgaaacacaaagcttccaatcttaaggatgtgaataaaaccaccaaatggcatttctagacagtttgacctgttatacagagtaatattctgtggccctttgactttgtgaatgagcacaatgaaatgccgcctactgatgcttcttatgatcagaactcttttttaataaaataaataacataaatcgttgaacataatgttccagttgaatgcaaaacaaaaaaaatatggaaaacattttgataaaattttttcctgttaaaaccatgaacattggctatgatgaagattattacatatgaaaaaaaaactcacacaacatatttgtattgactgaaggaaaccatcataatgcatgctagaattctttgaagcagtgatctcagtttccttatgttgtcttcagaataggcatgataaactataattgtagaaaggggtaatttctgtgcacttacaacaagctgagtgttcatgttccatggtgggctgtgcaaataaactccttttagacctgcagtatttctcatggggatgctcattagtaaatctaaagtgttcagatagttcagtattcattatcgtttaactttgcacctagatactgttacaactgcaataatttgttgtacaactgttgtatcaggaatcaggatttttttgttgttgtactttccagatccttatagatacggtaagagccacattcgtagaaaaacttctggtgtggccaggttttaggtaactttttaatccaaaactattgtgccataaatgtttttcagtaatattttttggtccactgtattcctgtgacacagtgcattatctgttcttgtatttctatagcacctctctattgggtttatcatcatcaacaagactactgtttactgtagttcaagtgactttcctacttttgtatttccaaaaaaaattatcttgtaagtagcttgtcatcaatccccttgtcgaaaactagaaaaaaaggagttgacccatataaattatctctaacgtctttgttgtttatggaaaagcccagatactggatatatcactatgtattttatgaacagaattgactgggactaatatcacaggatcaatcatctcagaatcttacttgatgcattatttattttgctttagatcttgaatacattttgagaataactaatgtggattgaaatgtagagatacactggagtgctttatttagcaatatttgatgaaagcatgctttctacgccattcaggaaggcagcacaaatttatctcagaaaggttcctgtgtattgcaaggtacaattttctccaataaatcaggagaacaggagtttgatgatgcaaagttgatctctgtacatttaagtgaaaagtctttataacttttcacccttaaaatatttcagcagacatgtctgcacatgacagtgtaaaaaagtttaatgtcaaatgcaaagtttttattcattccaagccaccactgtaaggaataaagcttagcttctgtacatggaaagagctaataattatccctctgtcagagatgagatttttaaatgcttatgatatttaatcataaaaagggattaatccaaccattttctagtaaagccagaaattcttgcttcccatttctagaatagtttctagaacagtgctatgcacatattagatcttaataaacatttgctgagtgaaagtaagataaactcaactatctcttgggaagaactggcttcattcctagtacatcttttaaaaagttactaattttccagcagtacaaatattaacaattatattaacacctgcctcatgtcagtttatgcttctagagcaatgtctagtgaaacttatctgatggcatttattgaaaaccttctaaaaagtagactaaggaaaccataatcagaattactatgtcttttgattcccaatgagaagttctattttcatgttcttaatattacatacaagaaaatgcagttaggttatttcaattgacaattctgcctcctcttttgatttatcacttacccaaaattattaattttattaggcttttggaaaagaaaaaaaactttttgatgttttaggtgatttaaaaatataccgtgttggtggtgaatgactattgatgactgtgttaagtgcatctgtattgtaagtgaaatgtaattatttctgtgtaccatatggagtaactaaggtcattgtttttgacaattttgtttgaaattcatatatcttatttcaaaggatagcataatatctgcattatgctggaaaaaaatagacctttggagaatacttaaataaaacatgtgcatgcttgaacagg

SEQ ID NO: 168294 - DNA, 530 bp, Homo sapiens
  Payload ID: 13118
  Gene Symbol: KCND2
  Gene Name: potassium channel, voltage gated Shal related subfamily D, member 2
  ENST ID: ENST00000425288
  CDS Start-End: 1-530
acatacagtcgtgcggacccgtgccggtagacaaaaaagctagactggccaggatccgggcagccaaaagcggaagcgcaaatgcttacatgcagagcaaacggaatggtttactcagtaatcagctgcagtcctcagaggatgagcaggcttttgttagcaaatccggctccagctttgaaacccagcaccaccacctgcttcactgcctggaaaaaaccacgaatcacgagtttgtggacgaacaagtctttgaagaaagctgcatggaagttgcaactgttaatcgtccttcaagtcacagtccttcactgtcttcacaacaaggagtcaccagcacctgctgttcacgacgacacaaaaaaacttttcgcatcccaaatgccaatgtatcaggaagccatcaaggtagtatacaagaactcagcacgattcagatcagatgtgtggagagaacacctctgtctaacagccgatccagtttaaatgccaaaatggaagagtgtgttaaactaaactgtgaacaacct

SEQ ID NO: 168295 - DNA, 2659 bp, Homo sapiens
  Payload ID: 13119
  Gene Symbol: KCND3
  Gene Name: potassium channel, voltage gated Shal related subfamily D, member 3
  Uniprot ID: Q9UK17
  ENST ID: ENST00000302127
  CDS Start-End: 481-2391
ggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactgggatacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctccgccttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggagggtgggggggtcggggatagg

SEQ ID NO: 168296 - DNA, 2716 bp, Homo sapiens
  Payload ID: 13119
  Gene Symbol: KCND3
  Gene Name: potassium channel, voltage gated Shal related subfamily D, member 3
  Uniprot ID: Q9UK17
  ENST ID: ENST00000315987
  CDS Start-End: 481-2448
ggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactgggatacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactgggttgtcctatcttgtggatgatcccctgttatctgtacgaacctccaccatcaagaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctccgccttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggagggtgggggggtcggggatagg

SEQ ID NO: 168297 - DNA, 7396 bp, Homo sapiens
  Payload ID: 13119
  Gene Symbol: KCND3
  Gene Name: potassium channel, voltage gated Shal related subfamily D, member 3
  Uniprot ID: Q9UK17
  ENST ID: ENST00000369697
  CDS Start-End: 71-1981
tttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactgggatacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctccgccttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggagggtgggggggtcggggataggccgggggatataggctatgtgccaggacagggcctggatggaggagcctcagactcagaccaaataacagtcgtttctggagaccccagtgaggaaaatacaagaccaagagcagcaaagaggccaagttgtcacaagcaaaacaggaagaaaatataacactgtgtatttaagcacctttttcaaggctcttaatggataatatttattcatgggaaaaggtggaaaacaaaaacaccaacggatttttgtgaaatgtttttctccatggacccaacacctttgaaccaaaacaatgcattttgtgagggatttttttttctccttttatagcaaaagcttttaggctaagaagtcagttattgctgagttctctctccattcccccaggtgggtgaggtcaactgagcctgggcccccactgcccagctgacctgtgcagagctgccaagtgaccacacggcaatccttaccctttgtctgtccctgtctcccttgtctctgtacctctctgcttacccctagctgtttctgtgtccagccatctgtctctacctggatcccaatgatcctgaaacacatcagtaaagccttcttcatcactgccacgcacaacagacttgtgcctgggagttctatctgtgtgaatgcaactgcagaggaggaaagagtgaagcaaaaattgggagagtttaggggtaagggaagtctacctcacagaacagaggtacttcccttggggttggaaccactcgtgtttgcagtttcagtttctgggaaagaaagggaatgaacagatttatcacactggaatcttgaaaaggcaaatcgccaacacctgagacgcggtcaactctggtatgtgccagtgaggggagaacggaaggacccagggctcgcagcctcagccggtcattagggcaccttgctatggacccttccttcaagacccaccataaagcccatccagagcccttccaagaggccccgggagtagttttctccagagagggcagtggtacggggaccaagattcctctgacttatatcaaaccagaggcaactcccacacagaggctgtggaagggtaagcctgtgtgcctcaagaaaaatgcttcaaagcaaaagcaagtaagagattctagatgattcttacctgctatgaaagatgccttgatgtctgaagaggcttcggcctgatctccctgaagatgctgaaatgggggagaagcctcatcacctctgtgcaagcaaaggagtgaagattatttcttgaacacctggacaacatatctattcaactagcttgcaccctggtggagctgggggcagcatttctggaatcctcctaaccattgttcactgcttgtagcagagtaggtgggcctcagggttagtgacaagtcctttcctgcccttcccaacacccagccaccttgctgcagtctctgtagcctgggctctgaaatacatgagctcctcgggagctgcctatccatcctacagcttagtggttagctgtttaattgtaggccaagaatttctctccccaccacagccatctaaatgagttttactagccaggaacctaaaaacacccttcgtgggcttccctatgaccccagctcgattgaccctgtaggttcaaaaggtttcgaggtggcacctaaccagaatgtgggcagaaggcagaggagagggagccttctttctgtctttatctctttatgcttatcctcattgaccatgggctgagttctttctctgggtcccctaatgtgggaatggagtggttcttgccctctgagcttacagactaagaaggcagaaaagctttacaactacagagtacatgtgtatacacacaaccaacctaaacacatcagagaatacatacttaaatcaattcacttcatatacacatctcattagaagaccaagctaaacttcacttagagggcgggcaaaggactagaaaagaatttttctcttaaaaaaaatgagtactagagcaaaattatgagtgtctaagtatcttagttatgcttcataagatctgactggggtaagagataaagaggtaaatagggctgggcgcggtggctcacatctgtaatcccagcactttgggaagccgaggtgaacagatcacctgaagtcaggagttgaagaccaacttggccaacatggtgaaaccccatctctactaaaaatacaaaaattagccaggcatggtggtggacccctgtaatcccagctacttggaaggctgagggggaggattgcttaaacccaggaggcagaggttgcagtgagccgtgattgcaccactgcactccagcccaggtgacacagcaagactccgtctcaaaaaaaaaaaaaagaaaagaaaaaaaaaaaggaggtaaattagaactggttgcacacacatacaaacttcctgtgatgaatttaagaacagatcattacagggttagaatagtgacagattcaacaaaggatctgtttgatagggcaccaagggaacattttactggttcccacaaaaattaataaatgttaaatatcatgtcccaagcaatttcccatgtttttttattggtcctaatcaacagaatgttttgtgttccttccacttcacgttcagagcccacgtcatgccacttcctaaaagaccattagaccatccccttttcctccatcctccactgtagccttagccagagaaaagatccagctcacttctggtccaaaaaatgtcaacgtttggaaaatggctcatctacactacagaacacagccagatgacactgctaaagggtactgtaagaaaacacaaggtccaaagtatgctgaattggtttcataagtctaactcattggccagtgactgaaaaaccaggatatcaggattttctgggggccaatagccatgacccttgagctttcatagttcatgaaccactttgacataataaaatattcccaaaaccacctattccattcagtcccactcagcattaagagggggagggaaaaacaaaccaaccaaccaacctaacagttacattcaaatgtcaaatgaatgtgaacctagaaaatgtagtattaagagcatatcagaactagaaaagatttaagaatatctaattcattttacagtatagaaaactgagacccagagaaattaaatgacttgttcaaggtcatgcagttatttaatgacagatctgagaccagaacacgagtcttttggctattagtctaatgcattttctaccacacccactgcctctgagagcagtgatgctttggagaagatccatcaaagaatccatactgtaattggagacatagtcttatatgtcaatacgtatatgtcaatactacttggacacagcccttggaaatcacctgactgtaccaatacaaaccatactttggaaaccaccattctctgggtagaaacatctatggactatcaattttgtcagaaatcagtgaacaagtgaagagtcaattttttttagtcaaatattttctcttctcaatgaagagaagactaggacagtgacattttgaagcataccttttatactccttgtggttcttatgacagtctgtgatggtagtaggtaaagtagctaaatccttgattcagagaggggaaaacatgtggaaagaaactgaacgacttatccaagttcacatgacaagttagtggcagaaccattattgcaatccaggacttaagacatcttgtcctaggatttttcctccacattatattgcactgctctgaggcttgcttatatttttcatacctggatttccagggtggtgacgtgggggagggaagtattcaattcagaaccaccgtgaaccaagatctctggaaacaaactctgtactatttctccttcatctcctattttcataactagtgccaagctcaggactaactgcatagactccctttcaaaagaccaatagatattctcagtgacagttgaacacattagtttacaatcacacagaatttgaacagaacttaaagttgacagttaatgccgatctataattaacaaaaatgtcaacttgtggatatgctgatgattttatccagttttcaaaatatgattcctacagttcaggatatcacttattagattgtagacaaggaaaatgtacattgggacattatgtacttaagagtttttccttaagttttgcagaggaagtggttgaaaattgagctaacactagatttcgaggttactaaagaattccagttttccagtctcccacttcaattaccaggtaactataaggcaaaaatatcccaatgctgtgaacttaaggcaatattcatttcctttctacactacttggcatggtaaccatgacaaacttttattttctctttctgatttcctaatgaaatctcattatttgcaaagctttaaaatgactagatgaaggaaaaacattgttatgacccatgaccctcggagcccaaacagcaccatgaagagcatcattaaaactaagagaaagtggctatcagaaaatgaaacagctttaaaggggttccttttaagtcttgttttctattcagaatgttctgtgttttttctcaagtgtgggaatgacatttatcttagcaggttactcaactacactggatgatgtcactctaaccagtgtacggcactgacccaagtcctggggggctccttggaccaatggactattttacaaacctgggaggtgggagggatggtatatttttgataatcagacattccaatgtaatgttttccttagaggtcacacccttccccccattaatgtcatcgtgagatacatcaagtgtgttcttttctattttcgtataataaatgggctttgcttatcaacatcacaatggcaaagaagaaatatactgtacaaaactgcaggaagataaaacatgaaaactttctatgaaaaaaaaaaaacacccttgagtttcctgtcgtcttcttttgaaactgtagtgcatatgttaaaacatgtatatcatttacagtattgagtcgtgtgccactgctgtacctgatgtatccaatctggattaaacaaattatgtgccacaaaccctaaaa

SEQ ID NO: 168298 - DNA, 3887 bp, Homo sapiens
  Payload ID: 13120
  Gene Symbol: KCNC1
  Gene Name: potassium channel, voltage gated Shaw related subfamily C, member 1
  Uniprot ID: P48547
  ENST ID: ENST00000265969
  CDS Start-End: 1192-2949
agcaagcggagcagcagcccgggcggcagcagcgtcgcggcggcggcggcagcggccgctccgcgcctcgcctcaccggcctcgctggcctcacctcgccgcgcccggacccgccacccccgcctccccgcccgacctccgcagcccccgtctcggccggcagcgcccaccgcctgcccgaagcgaggagcggagtgcggggcgcagaggcaccggagccagtgcccgccggccccgcaaatcaaacccagccaggagaacccccgcctggccccgtgcagctccgcgaccgccgggagctgtcccttcagcaccgccgcgggagcccaagtccgagcgcagcccagcggaaccccagctcgagcccgggctcacggagagcagcgctcggcgttagccgcacgagcaacaccccgggtgcccctgcccagggggcccgccatctcctccaggaggcggggagaaggaacgaggagggcgggcgggcaggcgggcccgccgccggggggagcaggcagccaagcaaggagagagggagggggccggagcccgccctgcgtcccgagctgcagcccggccacgcagggaggaaggcaggcggcatccatctcccccgcgccgagagcgcgccgcggcgaccacctcacagaggagcgcgaatttcccggccctgtctcctcccctccccctcctgggggctggcctctagtccggccccgggagcggctgacctttcccccaaaagctttgtgccgatttctccattttcccgcggagatggggacgggagcccggccccccaacccattttccccacctcccggggctcgctgctgagcccgcccccctccctctttccccctcactccctccctccctccctttctccctccctttctccctcccttctttcctcctctgcctcctccgctgccggaccagctccctcccacatctggctcctagagacccctgggatcccgcgcacattcccctggaccggcacccgacaaagcgcccggagaggcttggctcgctcgttggggtggccagagccgcaggcctctgttccccccgacggctggggggaggggggaagagggcgcgcgcccccctccccggcgccaactccccctggcggccgctcccatgggtgtcgctgggccgcgccatgcctaagggggcgccgcgatgggccaaggggacgagagcgagcgcatcgtgatcaacgtgggcggcacgcgccaccagacgtaccgctcgaccctgcgcacgctgcccggcacgcggctcgcctggctggcggagcccgacgcccacagccacttcgactatgacccgcgtgctgacgagttcttcttcgaccgccaccccggcgtcttcgcgcacatcctgaactactaccgcacgggcaagctgcactgcccagccgacgtgtgcgggccgctctacgaggaggagctggccttctggggcatcgacgagaccgacgtggagccctgctgctggatgacgtaccgccagcaccgcgacgccgaggaggctctggacagcttcggcggcgctcctctggacaacagcgccgacgacgcggacgccgacggccctggcgactcgggcgacggcgaggacgagctggagatgaccaagcgcctggcgctcagtgactccccggatggccggcctggcggcttttggcgccgctggcagccgcgcatctgggcgctcttcgaggacccgtactcgtcccgctacgcgcggtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaaggatctttgcaaagaaagccctgtcattgctaagtatatgccgacagaggctgtgagagtgacttgaccaggcggcttggccgaggacactggtggctattaagcatctgggtggacctgcagcccctcctcaccctcggacagagtaaattcacgccatgcaggtttgccggacgagtccgagtggcccaggcattgtactaggacggacgtagctttttctacggccaaatggtaactgaccgtagaggatttcttttccttcttttcattttttaaaattttattttatttggggagggggggtggaggggctccttagcatgacttgcatgaagttaaacagaaaacccagcaaaccaaacccaccaaccccctgcaactgtatgattaccctgaacaacaataatgaaaagaaaaacatcaaagccctctattttctttcaaagctcttgactttcacacacgttgttggagccaaactgtaacggcgttcagtagaaacctgtacatttctgggggtgaggggcgaggggaggagggacagagatggggaatggattgcttcctttttgtacacaagatcaagaggaaagcttccaaaaagggcagtcggtcagtcatcggtcatattgacctcaccttcatagttcatctctcacgtggaaactgagaactttgctccaaatagaattgtggaaactcgcacggctgccttcttccccgtttggcatgcttgtgacccagcggatgtctccccaagacccctgacagcagctagtctaggttgattctctcatcttatcggtgtgtagatccagtgtgaccaactttcataacaaattgttcatagtaaataatcaccaccgtatggattttccaagtgttccattaaaaccaggatgtagagcaccaaaagatcaggaccacgggaggagcagcctcctccacctttactaaggcacaacctggcattgtatgcaatttagtacttcagagtaaaaa

SEQ ID NO: 168299 - DNA, 6766 bp, Homo sapiens
  Payload ID: 13120
  Gene Symbol: KCNC1
  Gene Name: potassium channel, voltage gated Shaw related subfamily C, member 1
  Uniprot ID: P48547
  ENST ID: ENST00000379472
  CDS Start-End: 31-1566
gggccgcgccatgcctaagggggcgccgcgatgggccaaggggacgagagcgagcgcatcgtgatcaacgtgggcggcacgcgccaccagacgtaccgctcgaccctgcgcacgctgcccggcacgcggctcgcctggctggcggagcccgacgcccacagccacttcgactatgacccgcgtgctgacgagttcttcttcgaccgccaccccggcgtcttcgcgcacatcctgaactactaccgcacgggcaagctgcactgcccagccgacgtgtgcgggccgctctacgaggaggagctggccttctggggcatcgacgagaccgacgtggagccctgctgctggatgacgtaccgccagcaccgcgacgccgaggaggctctggacagcttcggcggcgctcctctggacaacagcgccgacgacgcggacgccgacggccctggcgactcgggcgacggcgaggacgagctggagatgaccaagcgcctggcgctcagtgactccccggatggccggcctggcggcttttggcgccgctggcagccgcgcatctgggcgctcttcgaggacccgtactcgtcccgctacgcgcggtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagcgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcaggtaggaaacctcttagaggcatgtcgatctgacctttcacctctgccccctgtagcgatgattccagatccagtcagactgcttccttagttccgtgggtgaccccggaccccgcactcagtctggaggtgtggagcctgggggcccagggagatgctgggcggccaaattcagcaggcaagagcctgctagaggaacctcactggtgcccctgggtaaggaggttgacgcggttggtctcgtgatgttctgaagagacaacgcggcccgccaggttgctgaggactaacttagcaggagccaggggggctctgcttggtggggcaggagtccggtgtgagtctctgactcaggctactgacccggtgttgggacagagtgggggcgggtgtgatttggaaacgctagacagcctttgatctggtccttaccatggctcccttcaggctgtgtagatggcagagatggtgcatgggatctgggcaggagggtcccttgcaaaggcaggtgcaagggttctcacccccggcagagcctgtctccatagctgagtagaattcctgccctgatttcgggctgcccagctcgaggtccttcccaggagacgcctgtagccctccgtgacaagcttacttaccccatagcatgctgaaccaactcatcttctaccaccactctagagtttagcctttatctttaggaacctgttgaagtgactctagctttcacgttgtctgtttgggttgatggtcgagtgggagtttccggtgacccgatggaagcggctgccgagcaaaagactagagggggccaccaccctgggcagcttagatgaaagcgctacagaccagcaacagcctcccaccgagggttctccccgtttccagcggtagggactgcagcagcaatatagacatcccaaccagtgtacaaccactttcccgtgaattcactgggggccgggaggggggaggggggcatgaaacaatactagtcaccgtgggatatattctaatattccatggctagtggtttgttatgggactatctcagttttatgagaacctgcacatagcacataaagttgatcatggggctctggtccgaagatataaagcccatagtctacctctacccatggaataccatcgacttattctgtggacacagggatttcaaaggaacagatgacccagagaagaatgacagcactgagtaagaaggagtgccaggtgagcaggaggttgacgtgacaggtggcatttagtctatgaaggacctccccatgcccaggtctggcaggaggctgctggctagctcagccccaggtggggaagtttccccctggtttgggtggcctcccccagtggatgattgattttcttccctgctatcgcgctctctgacccaccaccccatcccaatcctcttctggctttaccccacagctatgctggcccgagcactaccctcaaggcccatttctttgcccatgggggtttcccggtcctttcaccctgccgcatacccttcccttcctgggatttctgtaggtgcctgagaggaacatggccaggggtctccgaggctgaaacagctccgagctctctgctttggattagctagttacttgatttcaggagctaccaacagggctctgggcctctaggaggaacgcgtgggctggcccaggccccagcttccatgtgggcctggcaagaagagctcagcctgagtggcatcactgtggcactacctggcccttcccctgcatcctccccgacactggatctttcaggagtgttgccccaagcacaggtgccctgggccagccagtcaagaatccccagtgctctccaggcaggcccagattcctctgtactcttggacaatgacagtattatcctgtgcggagtccccctgccccccagggagtgcagatgtgtttgttcagacatgcacaccagctaatcccaggacacaaaacctgtaaaacccatgcactcctgtgggattgcccctgagctccacagtctctccccagccctgcttttgagagccactttgccctggtcccaggtttcaggggcccagacagttctggcttggacagtctctgtggctgaggaagtatttggggccctcacaagcttgccctctggagcttggatgcctggatccctcctgcctcccccgtcaccaactgtgctcccaagcccttcccaagcactcacttcccggtggtgttggtgctgtcctgatatcctgacccccgaggctccagcctcatccctcaccagaacacttctccctccaaaagctggcgtgtgagaccccggctatccgccaccaagaggagttgcggtctttaggggcgttgtccccacctctgcaccccagagttcttcccattcaccttttttcctgcttgcagccatgcacctagatgggcatagggttggggtgagtttgtgggagagtgagggggaggccaggggcaaggaaggtaaatgtggtggccccacaggaattgtgagagatgagatgcagccccccaaggcctttccagtctcactgtacccccaaggcagtctagtggcctcgccaaaacctgagcttctccaattccacttttaaaaccagagttaggggctgtgtgtggcacgctgggttctgagggcatccctcccgcccccccaggccagcccccagtggtgccagcagcacctgcccctcacctccacctcttggtctcgtctgaagcctcagtctgtgtgtctgtcccagggacaatctggtctcctcctgtgtgctgtggctggcatggcctcagtgtctgagggcttgtcctgggaggggtatcaagaatccaattctcacctggttgtaggacctcttgggggatgctaggagggcgccctggcacagccagggattgcctagggctgaggggcccaggagaagctacttctctcccagaaaggggctccctcctgcatctgcagtcggatgcccagaccgcccactctggacagcccacaatgcctcctccgtcctgccatgcccattcgcatgtgtcttgtccatctccgctcctgtgatgtgggtcagtcctttgtggtgccgcgtccagggctgcagggtcccacgtcagtgagcagtgggtggccggtggagggggtggtggtggccgggctcccttcctgcccatggcacctagaacagcagtgaggtctcagagaagcccccgcctgggctccctgggagctaaccttgcagcctctgggttatctttggcaaaggggtctaaagtcccctatccccagcccctctacttcccctgctgggcagcagtggctgcccagtgagtggtgctatccatggaggggggagggagctgggcagcgctgactaggcggcgggtggggctaagagagtttctgcagggacccagctgcagggtcagcagcctgtgggccctgagtggggtctttgttgtcctcaggtgggctgtgggggaagtagcggagaaatgaagtgacgccaggggccaggcatgggtgttcttttccgtgttgttcacattttctctctttctctctctctccactaatcatgtttctctctctctcctcgttttgttgcatgacttgtgccggttctcgtgattgttccctgctcgtgtctcacagactgtccccatttagcctgagacttttttcctgagtccccagctgggcagatccctcagggctaaacccaaggaaatgcccagcaacccccaacccaccccagccccgcgtgcgcccctccggtgcccgcagctggtgtgaacagtaagtactttggcggtgcctggagaccagggcagaaaagccagctgtgctgactgagggcccagcctcgggttctccttgctccaaagtttaaaaaaaaatgaccctctcgcagatgctcatctcagcccatttcaagcctggaaaccatctctgagacgctgcccatgctgccatttcatcactgcaggcctgtgggtctagtgggggcctgggggccctgggctgggggaggcagggcccccagcctctggaaagcaggtgggaatggaggctcctagccactatctcatccaaaggatggggcaggggcgggggctcacacctttgaccctattcatgggttccccagatttatacagttggcccctcgttggtttctctttcttcaagccacccctctggagttggggagggagaatgccccagtttctgaaagcatcttaaaccatagatagacgaacagcccaggggcctgggccccttcacagagcaagacttaagcttccccacccaatcattagtccctcctcaaaggttagggttgagagaagcagtaggccctaggggtgtcccgggaatcccccaggagggaaaggtgccaggctatcatccctccagggatccctgatggatgttccttgtcccctgcccaaaaccatcccgaactttgggccctttagtgattgtgagagctgggagcccccagggcctgggggcttgtggacagaaccagtgggcgggggcccagcattcagagccagagaagggtctcaggcggcaccatctccacagaggcagaggcagagagaaggcacccccctctgacccacccctccccaggcaagaactgcaggctgtggacacctcccctggcagaggatggccaacagagactcagcaagtcctcactcccctcccagaaggagacgctgcctgggaggacccactgttctccccttgaggaaaatccatgcagggtgctatgggcctcaacccccacatcgtcatccgcgtcctctccatactgtttccctcccctctcccaacaccctcctccctcagcccggagacccttggatggaagactgggccagccagagtgggaggcaggaccagcgtgtctgcgagcacacgtgtgtgcctgcagacatgccccaagaccccagagacgccccggccccagtcacatggtgtcagagttaccttggcaactggcctttttggttcagagtaaattgggaagtgaagcccctgggatttgtcgagaaacgcactgtacgtgaaatgctttgccatcttgtacgaaagactttttttttaagttccaaaattatgatgggatttttttggatttgctttacgaataaatctgattggtccatttctcttttga

SEQ ID NO: 168300 - DNA, 3563 bp, Homo sapiens
  Payload ID: 13121
  Gene Symbol: KCNC2
  Gene Name: potassium channel, voltage gated Shaw related subfamily C, member 2
  Uniprot ID: Q96PR1
  ENST ID: ENST00000298972
  CDS Start-End: 562-2403
actctttcctgagccctgtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagataactgcaaagaggttgtcattactggttacacgcaagccgaggccagatctcttacttaatgacttggggaaggcacaaaacatgagagaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaatt

SEQ ID NO: 168301 - DNA, 3344 bp, Homo sapiens
  Payload ID: 13121
  Gene Symbol: KCNC2
  Gene Name: potassium channel, voltage gated Shaw related subfamily C, member 2
  Uniprot ID: Q96PR1
  ENST ID: ENST00000350228
  CDS Start-End: 545-2221
gtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagataactgcaaagaggttgtcattactggttacacgcaagccgaggccagatctcttacttaatgacttggggaaggcacaaaacatgagagaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctgggg

SEQ ID NO: 168302 - DNA, 2485 bp, Homo sapiens
  Payload ID: 13121
  Gene Symbol: KCNC2
  Gene Name: potassium channel, voltage gated Shaw related subfamily C, member 2
  Uniprot ID: Q96PR1
  ENST ID: ENST00000393288
  CDS Start-End: 249-2105
agatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaaggaattagaaatgggcattccatcctacatcacctggataatggcaccaaatgccattatttaagaatcatcttttaaccctataaagctggaagattaaatatgctggaaaaagagttgtccatttaaacttaagtatgctttattggcttaggaaataaaaaatgaaaagagaaaaagtagcctacttatttctctttttttcaagaatacattctgaaatttaaaaatattagtcaagcttatatcttacttaagttgctttgcctaatttttaaatgagttctagtattctatatgccaaaattatattaatgctaactataatctgggaaaaaatatattttgaagtattgtaacaataatttgtgatggctggtttaatcttttcaaaatggcaactacagtgagcttcatttttttagagttataaattgtctcaatattaaattctttgt

SEQ ID NO: 168303 - DNA, 2168 bp, Homo sapiens
  Payload ID: 13121
  Gene Symbol: KCNC2
  Gene Name: potassium channel, voltage gated Shaw related subfamily C, member 2
  Uniprot ID: Q96PR1
  ENST ID: ENST00000540018
  CDS Start-End: 273-2024
gaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcaggatatgaaaaatcccgaagcttaaacaacatagcgggcttggcaggcaatgctctgaggctctctccagtaacatcaccctacaactctccttgtcctctgaggcgctctcgatctcccatcccatctatcttgtaaaccaaacaaccaaactgcatcagtcggctaaattgtattaattcaagtgctgtttaccccataatggaaataattaaatgtagagttactccaggctccattaatacagtataaatcttgcatgatactacaatttgaagtcag

SEQ ID NO: 168304 - DNA, 2931 bp, Homo sapiens
  Payload ID: 13121
  Gene Symbol: KCNC2
  Gene Name: potassium channel, voltage gated Shaw related subfamily C, member 2
  Uniprot ID: Q96PR1
  ENST ID: ENST00000550433
  CDS Start-End: 22-1911
agtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattatt

SEQ ID NO: 168305 - DNA, 5625 bp, Homo sapiens
  Payload ID: 13121
  Gene Symbol: KCNC2
  Gene Name: potassium channel, voltage gated Shaw related subfamily C, member 2
  Uniprot ID: Q96PR1
  ENST ID: ENST00000549446
  CDS Start-End: 682-2598
gtggagagtggggtgtaaataaggcaggcagaagctccagagagggtggagacagagcttcacggaagaaaaatatgtgaacctggttggtacacatagcttctccagacccacccacccactctttcctgagccctgtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaaggatatgaaaaatcccgaagcttaaacaacatagcgggcttggcaggcaatgctctgaggctctctccagtaacatcaccctacaactctccttgtcctctgaggcgctctcgatctcccatcccatctatcttgtaaaccaaacaaccaaactgcatcagtcggctaaattgtattaattcaagtgctgtttaccccataatggaaataattaaatgtagagttactccaggctccattaatacagtataaatcttgcatgatactacaatttgaagtcagaaatgccacttgggtagctaatgaatcttacccaggctttaaagattgtctaaagtagtgctaagatccctcctattaattgccctgatatccttttgcaataaaatgacagatagtgtcagatattgaccagtgcactaatatataaacataccttcagggagatatatttaaaacagtgtgcttccaaatgccaaccacttcattggaactttatttcttgtgactgtaaaccattctgaagatgtctgggatcctatcttgattgcacacgacatgacttgtgtcagctcatttgcatggaccatcttgtctctatcacctgaaagcaatgttgcagagttcggggactgtggatagctcaggatatgtgtacttgcatcgaaccatcctgctgatatgaaagcattggtcgactgttctgcatgttgaattgtggggcagggagggcacttttctccttgacatttttttcttattatttgaaagaaatatatgttttaaatagtttaatttcttgattgatttacttttcttcaaaaatgctgtattggagttctgaatgtctctggttgtttgcacacagataactgcaaagaggttgtcattactggttacacgcaagccgaggccagatctcttacttaatgacttggggaaggcacaaaacatgagagaaaggtaactgccagccaggcttgcattgtttagccagaaattgctgcttggttctagactctttaaaaaaaaaaaatacccagggtttgtcatcattttcagaggcagagtgccaaatatcacccaaagctcttgtgtcttttttttacccccttattttatttttatttattaattttttgtgcaaacatcaaatgtcactggtgttcacagaaggcttttttgactagccttaaattcctgagtcaaaagattaatcagattttcaggcagtgtttaatcaggtgctttgtcctgtatgttgttcttgtctgtcttagctccctgtctttcctgtatatgccatctgtctccatgaagcacagaaatgcctctgtaagatgtttatgattttaatatttactccctccaaacccgactccataccattttttgctatttggagcagcctctctgctttgtgtataaattaatgatgctctgtagactacctaagttaatcggcactgtgaatctttttgataagcagggtttaagcagcaatttcaccattgcacttggttgcctgctgcagtgtcagtttctactacctagcaaccagcattcattactacactccaacaaaatccttagggagtcatattcagtctgagtggaagaaagtctatttatgcattcctatgaattcaacagcaatagcgtgtctcatgtattgagcatgtgagggaagaaaaagaccgtaatataaatagagggataaataatatcactaaggcatttgggagccttgagactgctgattaattcctatttctcatgtttattttttgttaggaagacaattgtcacttttattattggccacgaaacatgtattactctatatccccaagtcctagagcatgacctgcatgttggagatgttgtacagcaatgtatttatccagacatacatatatgatatttagagacacagtgattcttttgataacaccacacatagaacattataattacacacaaatttatggtaaaagaattaatatgctgtctggtgctgctgttattgactacagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattat

SEQ ID NO: 168306 - DNA, 3026 bp, Homo sapiens
  Payload ID: 13121
  Gene Symbol: KCNC2
  Gene Name: potassium channel, voltage gated Shaw related subfamily C, member 2
  Uniprot ID: Q96PR1
  ENST ID: ENST00000548513
  CDS Start-End: 22-1863
agtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaagataactgcaaagaggttgtcattactggttacacgcaagccgaggccagatctcttacttaatgacttggggaaggcacaaaacatgagagaaagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctggggataaacttgaatgttatctgattaaattactcaaattatt

SEQ ID NO: 168307 - DNA, 5447 bp, Homo sapiens
  Payload ID: 13122
  Gene Symbol: KCNC3
  Gene Name: potassium channel, voltage gated Shaw related subfamily C, member 3
  ENST ID: ENST00000376959
  CDS Start-End: 165-2351
cccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagctcttgtcaccgcctgagacctcgcgagactttcggtcccccccgccccttccccccaggttacgagaaatcccgcagcctcagcagcatcgcgggcctgagcggggtgtccctgcgcctcgcgccccttgccaccccccctggctctccccgggccgcccgccgcgctcccccgaccctgccctccatcctttagcgctcccctcccccctgtggggggactcgggggtgaccgggaagaaggtcaaaggagctgggggtggggggtggggaaaagggtttttttaaaaaaaatcaaaaagtcattaataatatgcaaccgagatgacgatgccagcagacacccccgggcccctcacccccaacctgggcccccaggatggagagaggggccacagcccgtccccccaactcttccctccccaaaaaaagccttctcaggtctccacgagccataggacatccccctgccatcaacttgtgtaaataagtccaaattatgccagttacatcttggggcacctccccccacacactgcatgccttccctaacctggagcccccactccaagtccacctcagcaataagccgccaggggccgcatgcgcgggtttgaggggcaggcactctgggaagggggtggcacctcccgggggtcgggctggcctttaaggtctccagccttcccatccttcaccccaggaggacaaccaaccctgtgcgttgattaggagaaaacaaaccagaaactagaaacagtgtaggggaaggaggaacagttacccaagccccagatcggagttgagctcaggtggcgggagggcggggccgagttgagctcaggtggtgggagggcggggcgggctttggacctgctccctcagcctttaggagaattcctctggtgaatttcaccctctcatccgccccttcccccagggacctgctcgcctctattcttgctgcatggactcagacctcctatcccagaattcctgggatgatctggccctagcacacgaaattccccgactatctccctccattcccaggacatgagacctgcacccagaattctgagactgaccctggcacgccacatctcccaatccccacacactcctgcgacttaacctctgcacacagaggctccctgaaccaccctccctccccactcctgccaccccaaacacccccaccaaattccctgaactgcgtcccagcacttctcaaacctccaagacttgacccagctcttttcagctcaaattcagcctttgggatgctccaaatccttcccacaactgacatttcttggacacccccaaagcctcaggcctgttccgcacccatatccccaaagccctaacagacttgtccagcccaggttcccttgatgctagaacttccaagataggcgcaacctgtctgcaattccagggaaccagaccctccccaagcaccctctttgtcttacgcctaaccctgagtctcttccctgagatggtgccccaaaggtaccctcttcacagacaccagtgtttcccagagggttgtatttgtacctttggtggtgtgctaaggtttgaggcagtatgaggacaaacacttgttttaaaagttttgtctctaatacgcattttgtacagaagccgataagtgcaggcatcgctgcttggctaggacacggtttatttaggttaagagtgtttccatttaaagtagtccacagatgatcacagaggctgttcccgaagggaggaacactggagtatcagaagattgggaaccgacaacacccagctcggctgggatcccagccccccttccccagcggtcctcaccgcgtcacgctcgcgggtggaaaatcatttcccacctcctatcctggctcaaggatgcgctacctcccccaagcccagagaccacaccggtcccagactctttagcggaccccccttttggagccggggtcccacggaattagccacctccctccctctgctcccacggcctcaggaaccccccacccgagggtggatggggggcgtcactgagcacgattctcgatgcaacgattcctatgcaaggggcattttgagtcccccccatccttccctcggaccctaaaccctggtgaagcaggggtgaggggtggggcgggttttggtgggggcggggcaaagggctaggggctccagacaccagggtacggggtggggactgattatattgccaaagggttcaacttctttaacaagcccccccgtttcccctgaccttcacgaaagccgaaggaggcggggaaagggggtgagggtcttttccaaagggtactgacctcttcccaacgtctccccctgctcgccagtccgccacacgtacccagcttttgagttcagcttttcaaaataaccacaatcatgataaacttctacaaaacgtgattctcctcccctcccaccccatcccccaagtcaatagtgtgggattcggggagggagagagcgagctaaagggactctttccaagtccggctcccccttttccccccggccgccagggtgcctgcacctacacgcatgcgctgcatgacgcgccccccacacgcatgtcgcacccctcctgcgctccgggaacgcacggacacgggccagggggcggggcgattggggaggaatgaatggcggggggtcttcctgagctccgcggctcaccctccccaacacacacacacacacacacagagcaataagtttctctcactcaaatgtgggcggggcgggcctagcctgtcgctggtggggggagtggtgagggggcgctctcagggatgggggcggggttcggagacagtgtggggaggggaggtctgcaaatcgtccaactctggtgctaatggcgggtcttctcagcccacccgcagggcagggagggaggggtcggcgtggccccttccccaagcctcccccacgcccaccctgggtgcatgaaccgcccaatgcagaagctgccgcatgtcacccccctctccccaaagaaaaagtgtcatgcccccttcccacccaccctcactccccaccaaaataaacgtttccttttcatttaaaaa

SEQ ID NO: 168308 - DNA, 3347 bp, Homo sapiens
  Payload ID: 13122
  Gene Symbol: KCNC3
  Gene Name: potassium channel, voltage gated Shaw related subfamily C, member 3
  ENST ID: ENST00000474951
  CDS Start-End: 122-256
aggtcgcgacggcagccacaggtggcagtcgggggtggctgtaattgatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagctcttgtcaccgcctgagacctcgcgagactttcggtcccccccgccccttccccccaggttacgagaaatcccgcagcctcagcagcatcgcgggcctgagcggggtgtccctgcgcctcgcgccccttgccaccccccctggctctccccgggccgcccgccgcgctcccccgaccctgccctccatcctttagcgctcccctcccccctgtggggggactcgggggtgaccgggaagaaggtcaaaggagctgggggtggggggtggggaaaagggtttttttaaaaaaaatcaaaaagtcattaataatatgcaaccgagatgacgatgccagcagacacccccgggcccctcacccccaacctgggcccccaggatggagagaggggccacagcccgtccccccaactcttccctccccaaaaaaagccttctcaggtctccacgagccataggacatccccctgccatcaacttgtgtaaataagtccaaattatgccagttacatcttggggcacctccccccacacactgcatgccttccctaacctggagcccccactccaagtccacctcagcaataagccgccaggggccgcatgcgcgggtttgaggggcaggcactctgggaagggggtggcacctcccgggggtcgggctggcctttaaggtctccagccttcccatccttcaccccaggaggacaaccaaccctgtgcgttgattaggagaaaacaaaccagaaactagaaacagtgtaggggaaggaggaacagttacccaagccccagatcggagttgagctcaggtggcgggagggcggggccgagttgagctcaggtggtgggagggcggggcgggctttggacctgctccctcagcctttaggagaattcctctggtgaatttcaccctctcatccgccccttcccccagggacctgctcgcctctattcttgctgcatggactcagacctcctatcccagaattcctgggatgatctggccctagcacacgaaattccccgactatctccctccattcccaggacatgagacctgcacccagaattctgagactgaccctggcacgccacatctcccaatccccacacactcctgcgacttaacctctgcacacagaggctccctgaaccaccctccctccccactcctgccaccccaaacacccccaccaaattccctgaactgcgtcccagcacttctcaaacctccaagacttgacccagctcttttcagctcaaattcagcctttgggatgctccaaatccttcccacaactgacatttcttggacacccccaaagcctcaggcctgttccgcacccatatccccaaagccctaacagacttgtccagcccaggttcccttgatgctagaacttccaagataggcgcaacctgtctgcaattccagggaaccagaccctccccaagcaccctctttgtcttacgcctaaccctgagtctcttccctgagatggtgccccaaaggtaccctcttcacagacaccagtgtttcccagagggttgtatttgtacctttggtggtgtgctaaggtttgaggcagtatgaggacaaacacttgttttaaaagttttgtctctaatacgcattttgtacagaagccgataagtgcaggcatcgctgcttggctaggacacggtttatttaggttaagagtgtttccatttaaagtagtccacagatgatcacagaggctgttcccgaagggaggaacactggagtatcagaagattgggaaccgacaacacccagctcggctgggatcccagccccccttccccagcggtcctcaccgcgtcacgctcgcgggtggaaaatcatttcccacctcctatcctggctcaaggatgcgctacctcccccaagcccagagaccacaccggtcccagactctttagcggaccccccttttggagccggggtcccacggaattagccacctccctccctctgctcccacggcctcaggaaccccccacccgagggtggatggggggcgtcactgagcacgattctcgatgcaacgattcctatgcaaggggcattttgagtcccccccatccttccctcggaccctaaaccctggtgaagcaggggtgaggggtggggcgggttttggtgggggcggggcaaagggctaggggctccagacaccagggtacggggtggggactgattatattgccaaagggttcaacttctttaacaagcccccccgtttcccctgaccttcacgaaagccgaaggaggcggggaaagggggtgagggtcttttccaaagggtactgacctcttcccaacgtctccccctgctcgccagtccgccacacgtacccagcttttgagttcagcttttcaaaataaccacaatcatgataaacttctacaaaacgtgattctcctcccctcccaccccatcccccaagtcaatagtgtgggattcggggagggagagagcgagctaaagggactctttccaagtccggctcccccttttccccccggccgccagggtgcctgcacctacacgcatgcgctgcatgacgcgccccccacacgcatgtcgcacccctcctgcgctccgggaacgcacggacacgggccagggggcggggcgattggggaggaatgaatggcggggggtcttcctgagctccgcggctcaccctccccaacacacacacacacacacacagagcaataagtttctctcactcaaatgtgggcggggcgggcctagcctgtcgctggtggggggagtggtgagggggcgctctcagggatgggggcggggttcggagacagtgtggggaggggaggtctgcaaatcgtccaactctggtgctaatggcgggtcttctcagcccacccgcagggcagggagggaggggtcggcgtggccccttccccaagcctcccccacgcccaccctgggtgcatgaaccgcccaatgcagaagctgccgcatgtcacccccctctccccaaagaaaaagtgtcatgcccccttcccacccaccctcactccccaccaaaataaacgtttccttttcattt

SEQ ID NO: 168309 - DNA, 3176 bp, Homo sapiens
  Payload ID: 13122
  Gene Symbol: KCNC3
  Gene Name: potassium channel, voltage gated Shaw related subfamily C, member 3
  Uniprot ID: Q14003
  ENST ID: ENST00000477616
  CDS Start-End: 296-2569
accggtcccgcctcccttgacgccccgccccgcccctcctccctgctctcttagaaagagccaatcgctccgtctcattggcggccccgactcgtccagctgggtcgcgttagagtgcccgccccactcctcccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagccactggtgctcccccactgcccccccaagactggcgtaagccaggccccccaagcttcttgcccgacctcaacgccaacgccgcggcctggatatccccctagtggacgaaccccctccccccgggctcttgtcaccgcctgagacctcgcgagactttcggtcccccccgccccttccccccaggttagcaattgggaatggctgggagggggtgtccccaagacactgggcttcaaatctccccccaagccctccctcctacgatcaagacaccttttgtccagacagctcccttagcgttgcctggaaaagccacagagctccctgcgggggtgcagaaccctgcaggcagccccaggctttgcagaaaccacacacactgttgctggatcttgagtcccattagctgtgagatgcctgtgagagccttcccgcacccgtcagaagctcagagccttcttggaccctttaaagatgtccctctccccagccctccgcctcaccgccccccacccccgaccccgtccttagaatcttctggaggagcctccctccccccccacccccccccactgctcctggagttctcatcggattccccaagggcactgccagcttcgctccactcagcccccttgcagaccccaccccctgcctgctctctttccctacaactaggtcagcccccagccccgctacggcggccgc

SEQ ID NO: 168310 - DNA, 18750 bp, Homo sapiens
  Payload ID: 13123
  Gene Symbol: KCNC4
  Gene Name: potassium channel, voltage gated Shaw related subfamily C, member 4
  Uniprot ID: Q03721
  ENST ID: ENST00000369787
  CDS Start-End: 28-1935
ccaagccggagccccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtggggctgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgcctgcttcctgctcagcactggggactatgcctgcgccgatggtagtgtccggaaaggcacattcgtcctccgtgaccttccccttcagcattcacctgaggctgcatgccctccaactgctgggactctgttcctgccacattgaggaagggggctgggcacgacatggcatcatactcaggagccttcttcaccagctccttgggacaatggaatatcccagggtggtgacagcagatggagctacttgggggagagctcaagttggtcaggcaacagctggggtgatggcctgtgagccacaggccacatcaggaactttccccactgcctccatgcaaggctgcagagctatggtccctttctccactgcactggagctttgaagacctaagaggctagtggttcctggagctagtggttacctgaacaggtatggcgatgagctacaacatcacctgagtcaccagagttgggttggcagaggggtgaagggttcaccccattccctgacccatccatgctcttcctggccttttagccctgggttcctcatgccttccagctctgctcctggtctactccttagcccacaccctgtgggtcagcagctggcttccttctaacgtctcattctttgtttctccctttcttttgctgaactccctgtccccccaaccccagaaggcaatgttgagccgaaagcgtgcgtcccagtgtctcacacctgtgctctttaaacacagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctgtgtgagcacctgcctctgcctctcctttctggctctgtgtctattgggacctcctggggctctcacccctgacacctgaggagtgcacacactcagcataaccccactccagcaggaatcatcagtgtggcctgacccctgcattttacagggagagactagtgctcagagagggcaagtcatctgcccaaagccacacaaagaggactaacccaggaccccgagacccaaacagtgttctaatatccactgctgtccccaagcccctgccataacatggaagaaaagactgttctttgtttaaggaattccactgcattccgtttgtgcagggggcctcccctcctccctgcaattgtaccagttctaaatgggccaagaccctggggacgccaaagttattggctggatggctgatgaactgaggccaactagagactggtggcacaactggggaccacttagggatggagagtgaacacatcctgggcctggataggacggggagatggtgagtgatggtcagacgtggcccttggctctcactgttgttatccctctcacgttcacataggggcacacgcagggccagcttcatgggtgtgcaacctgtgcagccactcagaagggccccatgctgggtttaatgcttggctgtcaccatcatgaaattaataatggttgaacaggggccctgcgtttccatcttgcaccaggctctggcgggtctggttgcctgcttgcctctccttattcttgtcttactcctcactcttactctgggcatctgtgtaggaccataggggcctcaattcaaagtcttgctttgctgcttgctagctgggtgacttgggggtgactcaccgaaatggtttccctgtttgttagggaataatgatggcccctgtttcagagacagagtgaagagcctggcctggtgtcatgtgtctacctgtgatatgacatatagtagcggcacagtgtcagctccctccctgccctgttcctgtcactctcagacttttctccacagacttctgagatctccgtgtccagctgcaccaagaaaggacaagaacacacccgggagctgtcttgggcagtgtagaacagcagggtgaggacggaatggccgaggagagggaagaagccaggggaagcctgttcctgaagtgtaaggaaagatcgggcttggagcctgggccagccgaggcaagggggtggcaggcagccagtgtcaattaaagataaaatttctcctccggtagtggagggcaaacagtggctgtggcccccctagacaggagaaagccatttgcagccaggctggccttggaaaagcttggccaggcgataatgggacgggatgcgctgctgactccataatgatattacgcatcagggcccacggccaaagtggctgttttttctgtagatcgatgtggaaccatttcatggtcaggggctgagaacccagccagcagcaggggtactagatgccagagtggtcctgaggggactgaaggggtggcaactggggtccccagtgaccgtttcaggctgctggaagaggagggggcagtgtgcaggagggtggaggggtggacgagagaagcagcagactgcccctcctccccacctcacagaaacagcaggccgtgctgtcaaggaagaaagggctctggcttcctcctgttccccaaagctggagtcgagcccaaggtagggagctggttaaaagaacaggacattgtttaaaagaataagacagacttttgaagtcaggcagacttgggtttgagtcctgactccatcacttccttgttgtgtgaccctgggcaagttactcagcctctgtgaacgtctatttcctcatcttttaaatgtagtatctgcctgaggccgtgtctctctcattgagccatgaggagaaatgagtcggcgcctgtaaagcctcgcgcacagtgcctagcacataaccattgctagagggagaggggagtattttggggcaactcactccagtaacagatgaccagtttggtttgatgacctcacttttcagtgaatcagcctcatttcactgaagtccttagtccttatctccttgtgaaggaataagaggggatgattatacctaacagcgaacatttattgagtgctgggcagtacatttcatgcttataaagatgcattccaagattgatgttatccttacctttgttttacgaggagaaaaccaacacaacaatgtcaggtcatttctccaaagtcacacagccattaagtagcaaagctgggattcaaactcagtctggctctgtgggtccaatgcttagccactctctgaactgagtggggcttgtgagtcataacctccagtgtaggagtttgtgcttttagtgttatttccttaactgcaattgattctcatagcaaaggtattgttttccccttttacagataagaaaccaaggcttggagaagtgaatcattaaactcactctcccttttacgtgtatgtaccccaccccacacacacataaagcgaggaggaatgtcctcttgggattcattcattaattagcagcaggcaacacccagctcagtgactgcttggttccttccctctgcgaccccactggagttttattctctgacgcacagaagtgggtaagtgggggtaggactgctctggaacccaagttacatgaggagtggctcaagctggagaagtcttggaaacctgatcccaactaccaggtgtttaaagggtacctgtggggaagtgggtttagattcttctctgattgcagagagcagatccggaaataataggtggaaatgttaggagggcagattgggtttaaattttaaaaaatctttttttaatgaaatttttgatttgtaatttttgtgggtacatagtaggtatatataagaaccttattttctgttgtttcccttgctattataaatttattactgccagtcatggtggctcatgcctgtaatcctaacactttgggaagctgaggagagtggattgcttgaggccagaagtttgagaccagcctggataacatagtgagaccccatctctacacaaaaaaaaagaaaaagaaaaattagccaggtgtgatggcatgtgcctgtagccccagcttctcgggaggatttcttgagcccaggaggttgaggctgcagtgagctatgatcataccactgcactccagcctgggcgacagaacgagaccctgtctcaaacaaacatttatttaatacaaggtattggaaaccatccccataccaaatcaacagggaatcccctgtcacccttcctcagtcccactttcctccccagaggtgacatggttaacatctggtgtgggtcctcccaggctttttggaaaaaaaaaaaactttctaacaaaattaccaaatcaaaatgggtttccctgcggggtagtgaagttcccttccctgaaaatgtttggagacacagtggatgatcatgtgctgcaccagggttcgtgggaagtatttctgctcggcgtgggaggtggaattagaagactgtttccaatcctaagactttctgactcacgtggcacacacagctagttagtggtggaggcaggtccagaacacaggtattcagatggggttcagatgaactcctttcctagcaagattttccttaaattcttctctgcctcttcccagcccatcagggatatagggcagggcagagagacatctgtgtctcctctagtctggagcgaggggagtgtcctgggcctgggttgtgatgccatccagtgcccaccctcgtggggctcctgtggcattattgcagtgagcactttctttccgttcctggctccaagccctgtgtgtgcatacactggtacccacacaagaggtagcacgtgagctggctcagtcacttggggctgtggtaaccgcattcaaaatgcagcatcatgctaaagagccgctggggactctggggacaaggctgtctccgacccagctttagggggtgaggagagggagccaaacggctacagctgcaagtcaaagaggtcagaggccttctgatgttggcactggaagcctctcctttctttccccacaggttatgggggcttctccactccccgctcttacttgcctgcttctccagggatccctagaagagcagtggttagcaagcatatgctatagccatcaaatacgagtctacagaaatgtaggcttccccttggggctgagttagggcctctgcttctgaaatgagcaacctctggttgctggtgggggctagggcttgctccctttctctcctcacatactctttcctgggtgacctcatcccctcccattgccttaaacatcttccaggtactggtgtcatccacttgtgtagttccagttcagaaatcccgtcagctccattcattcatttgttcattcattcagcaaacatatgtggcatctctgtcccaggtactgctctacaacctgggtgtacaatagggacccaaacagacactcccttccccatgcactccctgctcacagacacacctgcgtggcagtgcctgggtgtcttcacagctccctgatgccgagctgtgatcccacccttctgcctccctggtccccctcagcgtgctgccaccattcaccttgaggctgagatagatgttgtcaaaaccaccctctcattccttaattcactcactcatttttcgtgcattaaatctttattaaacacctgtgaactctgtcctcagggaaacaatggtgaacaagaccaacaggatccctgccctcatgggacttacattctaatcagggagagaggccagaagaccaatagataaaaaatatctcccacccgtattccaacctattaccaagttctacatttctagctctgcaggagcctcctcccaggtctccctgggtcccatctgcccttctgccaccagtctccacccagtcaccagagagagagcttcttaaaatggaaactggatcagatcatgtcacccctgcttagaaccctgtcaatggctgggttcccacttcgtgtacaatccagactccttaggagggcctgtgatgccctgctgctcctcatggccttcctgcctccgcagacctattcatgcccctgctctcagcccctgagaccagcagctcactttcctgtcagtttcccacacatccccagctctctcaccttcagtgtttttccacttgcttttccctcacggggaccacttcaccccagtccagccccaccccacctccttctcttggctgagaaggcctggctgtaaatttcactttcttggtgaggcgttttcccctcacacatccacgcccctctgcctctgtcagtttccatcactgcagccagtgcattttcttcatggtacttacagtcctttgtaactatgaattgtgtattgcctgcttccctgtaagttgctagggcctataggggctcggtaaatattttatgaacaaatgaatgaatgggctggagataggcctggcatgagcagctgctgaactccatcctctcttattcctcgcaagctgtctccagctggcttttgcacctcatttctagggcattcctgggagtccttggggaataacatgaacgctcttctttttacattatgcatttcctgcctgagaaactgtcagaataatgaggaagccttggagagagagttcccatagcccttcctctctcttccttttagaacctaccattttctacctggtactttttggtacttgtcaaattccccttcccacagtggcgagttgctcagaggtgctggttcatcccagctcccactcgagggcctagcttagtggtccatgcagagtaggtgctcagcgaaatgttgaagtgaatgaaggatatggtgagaaaggaagcaatgagtaagaaggaagagtgagaaagaaggaaagaggaagaggagggaggggcaaaggggttgatgaagagtgaagaagcagagggagggaagtgaggtcagggagtgggaaacggggaaagagaaccctggcccggtgtccacctcaagccagcaccctaccccactccttccagtcttcctggactcggagcctcccaggcctgccccagccttaggtgggacagcagggttcctccagcctgccactgacaccaagggcaccctgaactcagctcagaccccaggctgcccggagcaggagagactgctcctgaagagacttctgcagggacgagagcccaggattccttaacctgaggcccagctccatccctgagatccctagagactcccctcagctcccctcccctcagctcctcatattgagcccctgatccaaggacgattaactccaaatccagcatcagtgatcaaatgttcatagcaaacaaaggaaaacaaacaccacctttcctccttgcctcagccctggggccccagaggcttggctcagagacaggtgccctgcctcctccccacgcccggcacaggcctgccagctgcccctcgagaagaccaggggccagcctcagaggcccggaggatctgttcccagagtagctgttgccacagtgaccctccctggggtggtggctcctaagctgccatgggaggcagagctgtgccactaccacgacgaccaccaccaccaccagggctgccaccacagcaaagctgctcctggggcctccctcctagttaggctgccgagagaccagtctgtgctatcctctcaccatgccaggcagccacagtaccagggaacaggagtcacaatcagcccccttccaacaccccggcagcatcccgctgtctgccccaggacccgctcttcccctgaggggatgacactgcccccctggaaaattgattagggacctcatttctgtcagcaccccactagagatggcaaccagctcccagggcgcctgggggcgggatgttgagggcagcagggaggtaagaaggctccagtgataccaggctccctctgggcctcggtgctaggtggtgacaagctgggtttccctggacaggactggaaagttgctctctaatactctctatctttctgcttgggttctttcccacccctgccagaggctcttgctaactactgtccccttacatactggcacctaaacataaacacacatttccagagtcgtcctgctctcttcattttctgacctatgcacaagaaagtattttgtgtcagtcatcagcactctagtatgaatttagggtccatgtatattttatttcccaggagataggactgttgaccttctctcaacttgtggagtgacagccttgttctctgtgataggaagtcctagcaccagagagctccaagcaggatagataattttttcgattaggagaggaagaaatccaaaacttcctgtgtgggtcaaattaggggccagagctctacaaggaattctggcctgactccaattaacaaagaaggacgtggagcgcaaaagagaaatccaaagtgatatgcaatggaggctgcctctgtctggaagatcttcctgctccttgtgctcccctcttacattctactattgtgtcctcagcctggcaaactcttactcatccctcaaggcccactcaactgtcacctctgagaatccttcctgggctctcccaggtagaattcctctgtcctttatgctctcacagaaccttgaatattcctccattatagcacttactgcagtgataacttgttgcttgtttactcatttatggatgctttccttattaatgtttttacctccagcccctgctcagtggtcaggagctcaaaggtgaacaaaggaatgagtgaatgagtaaggagtgaatgaattagctgccctctgctgacttctgcccttcacccctgtcattctagtccatggttgggttgtaagatttgtccagaataattatccgggatgctggacctctcactctgccatcccaccaccatgtgccagccaagtctcctctcacccacgccaccctcaccatcagtactcccttccaaagttccccatttcccctcaactctccaggcttcagccatctgggcctttctttcctgatgttagtagcttcaatttacatcacagttaacttggaacagcggggggggctatatcctgggtcctttctccctccgtctgcttccttctcagtcttcattagtggtgttctgtgagcctcccacccaccccaactctccgagtgctagttaggtgctcaggtttgtgctcttggatgaaactcctgctacataagtggacatagaaaaagaggctggcaagggttgtttccagaggggtctgagccaatcccacgctgttgctgggcttgaggttccacatctgtgaatgggaattaagcttcccctgccttcatccaaggtgggatgataattaaatgagagtggatggatgggtcctttggaactcctgaagcaccactggaggcaagggattatcattcttctggctttctctctgtcgaggacttgggtgttcctccagagtcagagggcaggtgcctctggaaggtataatagctaacgtggattgagtgtttacgaccagcccaagccccctacatggcttaatggatcagagcagccccaggaggtaagggctctttttatcactcacattttacaggtgaggaaactggagagtaatttgatggagatctcacagatagatttcacaggcgattttgaccatgcttctacactggctctgtggccagccccttggcaccagcaccaccactgccatcgatttctggtccacggccagattgctaattctggctccactggctttgccacttgtgagctgcgtgaccttgggcaaatgacttaacctttctaagcatggtctgtgaaatggagagaaggaaacatctccagattttgcccagaggagtaaatggaggtgggatatgtgaagtggctctagacccaggcagtaaacagtgctcagtgtgtgtccttccctattgacactgacagaccctgcctggcaggcctgagcacaacagaagcactagaagtccttttccagaaattccttgctagggcctctcactgtggactgagaggatggaggcaggtccaactcgaggcagggccttgggacaccagtgctcatgagacaactcactgtcatgaccatttccgccttagcgacccagaagtggtgacacctgtgtgcttgcttcccgaagcagtgagaagccagacggagacccacacagctgctggctctaaaggctgctccctgcacgtgggcacctcagccccaccttccattcctctctctaacctgcttcccggacctgctggggccaggagctgccccaagtcctttccacacacacctgtgagctcctgggaatgagattaaaggaggcagggaggtgagaggaagcacaggggaagactgaaagcagatctcagaagctgagaagaggaagatgaagaggaggaagagggagaagggagagtggcagagagaggagcagtagcccgcggagcagggagagaaaaagcaggtagggaagggggaggggcagaggaggggaaggaggagggcctgcacccggctgtgggcagaggctgcggggcctaaaatgaaccgaacaggctggaaatagaacagctgggcaaaccccaaacgctttgtttgggtgtctgctgagcaagcacgtgaatgagaagaaaggggcaacaatgcaaggcagaagtggctcatttcactctggaggcaggtcagaacaagaggcatgtgttccagtccagcacagattagtcggggttctttttccgggatgttttctttacgtaatcattatttttcacaggctggcttggtggcgggattagcctgacgccaccccatccttggcaggtggaaggtttgggttactttgagaccaagaccactctgggttcttattctaactgtggatgccaccggcttcgggagaagagatcttaatccactttctaaatggaggtttaggaatctaagctgtgtaatggaatactatttcccttattagaacaaaccctaactcgggtgcggtggcacacgtctgtagtcccagctactcagcaggctgagatgggaggatggcttgagcccaggagtttgaggttgcagtgcactatgatgcacctctaaattagtcacggcactgcagcctgggcaacatagcgagactctgtctaaaaataataataataaataacaaaacccagttccaggatggatcaggactagcctgaggggccctgcctgtctcagctcaaagaactgcaccatgcctcacacacaccagcacacttcgccctgggaggtgcccaggccacctgaggttctgccatgggctggttccttccctgatcaccagcagcgccacctctgtgtttttcccctcctctccccacaacccccaacacacaatatgaagaaccttcagtccagaaattagacatgggaccagcagaggctatgaaggtaactggagccaagtggcccccagagctgccatttagcccaatccaaggtgtctgcactgtggggcatttgcttcatcactgacttctctagaattcaggtcagctctacttgggcctgaatgtggacaggaattagggggcccgaactccagcctcgcttccaccatgggccgtgcagtctttggcaacttgcttaacttggctgagcttcagttccccgtttgcaaaattggggataatactgcccacctcagcgggttctcataaagctccaatgagatcctgtgtgcctcctacttagctcaataacttgacattctataaggtttaatttccttccttcctctctcccttcttttctgaatgagctctaagaaccttccccaattcactagagaacctttgaggaaagctaaattgaggagaaaaggaacacagcccagcccacagcctccccatgaggggctggggctggaggggtaggtctggcggaggagggaaggggagacatgagtgatcagaaggtctcaacctaagtgctggcggcttctgtgacagagaggcaactgaacctgtatatggtatttggatcacagctggaaatccggctggattttggctttaataaaatatttgacattttgtggagctcagttttaaacatggggccgagagctggcagacctaggtccattcctcaagttctaactcagttcaccctgctgctctgggcttcagtattctctgctctccctgtcgtcagatggcattcacatgaagacccagctggtgatcaattcgtggcaaaaagtgtcagaagctagaagacttatctccggtcagtgttttcaacatggtagttatcctgcacgtggtgattgtacaaccctaagtggaaataggaccctaaagtccactctcttccaagactagccacttagaaacataccagcaaccataaggaagctgatttaagaccccttggccccgctcccataacacacgcccaacagagttggcttgactatggaaccatcccaaaatctctcctccacactgcctcttctcttcctcttctcttctcttggcctgaagaagcttgctcagtgcacgtatcttgtcttcaggtagaactagaagttgaacaagtcagtttcctctttctgacattgagagggtgggtatcaaggaggatgtttcagagaacgaagaggttcttggctctttgtactatctgtgcctgttccagctctagctgcccttgtttgacctgcttcttgcaggaggtagtggccagcatcgtagggaatgcccatgaagtactctgggcttctccgatgtaaagggtgagaaaaatcaaagccagctcttatctccatccagatggtggggataaaaacagtccaagcccgtttcttgcctcacttgtccagtggctaagctaatgccaaactgggatttctctgacctcatgttaacccgacctcaaggctgccagagtatcagctactaaatcaccaatctataaaagtcatcttgcagccttttccagatcccagaaggagtctttactccatcctgacctcagaagccaccttgcatcctctgccaatgctttcttcttcctgtatttaggaatcacatctatcacttggggtccagaaaacatttttagctaccaaccatgagtcagacttcatccccatttacaaccgtgtgactagagggtagggagttggagaagattcctccagccacagaacagctccttgaacaagcttttgctaaaagacaagtctcctcatgcccttccttttccgaaaagtcttctctgactccctgctggataaaggttagaagcttgagcgtggcttccccagaaccttcaccgtctggtcccagcctctcttttgggcctcagtcagtccctgccctccctcccacacactcgcactccaatcccatgcacatagaagtgtttgaatgtatgtactttcctgctttgggttacacgcttccctttgcttggagtgtcccctggctttcctccacctgtgaatctgctcatcctttgtgaagtcttttctttctttttcttttctttttttttttttggtacacatttattgggtacaagtgcaattttgccacatgcctagttgcacagtagttatatcagggcttttagagtatcggtcactcaaataacatacattgtacccattaagtaatttctcattgtccacccctctcccaccctctctccctctgagtctccattgtccgtcattccactctctacatccatgtgtacacatttttaagctcctacttatgagtgagaacatacttgtctttctgtgtctaacgtatttcacctcttgttccggctgtgttgctgtaaacgacataatttcattctttttatggctgaatagtattccacgtgtatgtgtatcacattttctttatctactaatcatctattggtgggcagggcatttaggttgattccatgtctttgctattgtgaataatactgcagtaaacatacgagtgcaggtactttttttttttttttaggcaagatctagctctgtcaccgagactggagtgcaatgataccatcacagctcactgcagccttgacctctcaggcccaagtgatcctcctctgagtagctgggaccacatgccatcatgcctggctaagttttaattttttgtagagatggggtcttgccatgttacccaggctggtctggaacttctgggcttgggcagtcctcccgcctcagcctcccaaagtgtagggattataggtgggagccaccaggcctggctttcttctagatatattgatttcttctgtgaagtcttttcttttttctttttttttttttttttttgagatagtcttgctctgtcacccaggctggagtgcagtggtgcaatctcagctcactgcaacctctgccttctgggttcaagtgattcttctgcctcagcctctcaagtagctgggactacaggtgcgtgccaccacgcccggctaatttttgtatttttagtaaagacgagtttcaccatattggtcaggctggtctcaaactctgaccttgtgatccacccacctcagcctcccaaagtgctgggattacaggcatgagccaccgcacctggccttgtgaagtcttttctaatccaccctgtcccactggcagaatgtttcgccccttagccagtgatatgcctttacaagagcatatgttgcactagatgtttactcggctgctttccacaggccctttcaaaggccatagattagacccacctttcctgtagccctggccaattagatcacagagacctatgtagatatggtaggaaaaatgatccagaatgtagctgtgacctggaggatgcctgcatgttccttcaatatcatactaaggctttgtctgtcatgaagattattaattctctagaagtgtgctatcaacagatggctattgaacacttgaaatgtggctagtgcctcatgtcaaaatgacaatattttgaatgtgttaaataaattattaaaatgaatttctcctgtttgtttttactttttaatgtggctactagaaaaatttaaattatacccctggttcacattatatatccactggaaagtgctgcagtagcagacaataattgtttgactttgtcatttgctattattaattaagggctcaaagtgtgaagttacatgttatagggttttgtttttgtttttgtttttgtttttttttggcctgttagagattcaagtgatttgtatccagtaggaaaaataaccccagttttatttttctgtaggacattaactagatttgtattttttaaaaaattattttggcgtgccttttaaatcccagttcctcaaatgctctttgaatcaactttattatcgtattgtttcccttgtcagttaatgagttcaataaaatctttgatacatattcatactttaactgtatgagacttgtgtttctaactttttggaaattatactttgacatatctctgtctcctgttcggcttgatggcagagactcaattattaacatacctagtattaagtagggactcagtaaatgttgaatgaataagaagcacttgtttagaattgaggtcgaaagtttaaactgccagccaaactttgtggtgggatccctatcagccacatgtctggagagtggcagatgcaggaaagatgagacgttttcaggatcctgaactatttgggtggtttcccagtttggggggcctgtgatcccaagggaatgctggccaaagcaagtcccttctgtcagctcaagggtgaggtcctctcaggctccccgcccttcccacccacctggggtgctgcaggaagtatggagcccagataggactcttgtcccttcctgcc

SEQ ID NO: 168311 - DNA, 3018 bp, Homo sapiens
  Payload ID: 13123
  Gene Symbol: KCNC4
  Gene Name: potassium channel, voltage gated Shaw related subfamily C, member 4
  ENST ID: ENST00000413138
  CDS Start-End: 9-1883
cgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtggggctgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgcctgcttcctgctcagcactggggactatgcctgcgccgatggtagtgtccggaaagaaggcaatgttgagccgaaagcgtgcgtcccagtgtctcacacctgtgctctttaaacacagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctg

SEQ ID NO: 168312 - DNA, 2953 bp, Homo sapiens
  Payload ID: 13123
  Gene Symbol: KCNC4
  Gene Name: potassium channel, voltage gated Shaw related subfamily C, member 4
  Uniprot ID: Q03721
  ENST ID: ENST00000438661
  CDS Start-End: 1-1881
atgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtggggctgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgcctgcttcctgctcagcactggggactatgcctgcgccgatggtagtgtccggaaagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctgtgtga

SEQ ID NO: 168313 - DNA, 3487 bp, Homo sapiens
  Payload ID: 13123
  Gene Symbol: KCNC4
  Gene Name: potassium channel, voltage gated Shaw related subfamily C, member 4
  Uniprot ID: Q03721
  ENST ID: ENST00000469655
  CDS Start-End: 158-2065
gggggataggcaggggcaagcccaagccgcagagggggccgccaccgcctcctgcctcctcttcgtctcctccccctcccccgtctgacgctgcctcctcgggaagggtgtttggagggcagcggccgccccaagccggagccccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtggggctgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgcctgcttcctgctcagcactggggactatgcctgcgccgatggtagtgtccggaaaggcacattcgtcctccgtgaccttccccttcagcattcacctgaggctgcatgccctccaactgctgggactctgttcctgccacattgaggaagggggctgggcacgacatggcatcatactcaggagccttcttcaccagctccttgggacaatggaatatcccagggtggtgacagcagatggagctacttgggggagagctcaagttggtcaggcaacagctggggtgatggcctgtgagccacaggccacatcaggaactttccccactgcctccatgcaaggctgcagagctatggtccctttctccactgcactggagctttgaagacctaagaggctagtggttcctggagctagtggttacctgaacagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctgtgtga

SEQ ID NO: 168314 - DNA, 4086 bp, Homo sapiens
  Payload ID: 13124
  Gene Symbol: KCNAB1
  Gene Name: potassium channel, voltage gated subfamily A regulatory beta subunit 1
  Uniprot ID: Q14722
  ENST ID: ENST00000302490
  CDS Start-End: 872-2077
agttccaactgttgtgctgcagcagatttggtctgagtctgggcagagcccctttttatggagcaaccctcccgatttgttacagcaagagcctggtgcaagtgatctttgccttcccatcgcacacaaaggcaaagagctccttaaagggacctgcctgctcctccgtgcagctgcaaacccgtgtcggtgcaggctcagcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaa

SEQ ID NO: 168315 - DNA, 1119 bp, Homo sapiens
  Payload ID: 13124
  Gene Symbol: KCNAB1
  Gene Name: potassium channel, voltage gated subfamily A regulatory beta subunit 1
  ENST ID: ENST00000389634
  CDS Start-End: 1-1119
atgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataa

SEQ ID NO: 168316 - DNA, 1806 bp, Homo sapiens
  Payload ID: 13124
  Gene Symbol: KCNAB1
  Gene Name: potassium channel, voltage gated subfamily A regulatory beta subunit 1
  ENST ID: ENST00000389636
  CDS Start-End: 35-1207
agtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaactggctctgctgcgcgaagtggagatgaactggtacctaaagctctgcgacctgtccagcgagcacaccaccgtctgcaccacaggcatgccgcacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagtttt

SEQ ID NO: 168317 - DNA, 576 bp, Homo sapiens
  Payload ID: 13124
  Gene Symbol: KCNAB1
  Gene Name: potassium channel, voltage gated subfamily A regulatory beta subunit 1
  ENST ID: ENST00000489036
  CDS Start-End: 1-246
atagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgat

SEQ ID NO: 168318 - DNA, 3301 bp, Homo sapiens
  Payload ID: 13124
  Gene Symbol: KCNAB1
  Gene Name: potassium channel, voltage gated subfamily A regulatory beta subunit 1
  Uniprot ID: Q14722
  ENST ID: ENST00000471742
  CDS Start-End: 218-1444
atgcacaggcctgggcagggacacacaaccaacagctctgtcgggaacttaggagcctgctcgcctacaaaaatgataagagagatctaaagaaaacaagctaaaccttttgagggacatactgaagccagataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatctt

SEQ ID NO: 168319 - DNA, 3122 bp, Homo sapiens
  Payload ID: 13124
  Gene Symbol: KCNAB1
  Gene Name: potassium channel, voltage gated subfamily A regulatory beta subunit 1
  Uniprot ID: Q14722
  ENST ID: ENST00000490337
  CDS Start-End: 65-1324
agaaaaatcaattcagattactttgatgacagtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaactggctctgctgcgcgaagtggagatgaactggtacctaaagctctgcgacctgtccagcgagcacaccaccgtctgcaccacaggcatgccgcacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaa

SEQ ID NO: 168320 - DNA, 552 bp, Homo sapiens
  Payload ID: 13124
  Gene Symbol: KCNAB1
  Gene Name: potassium channel, voltage gated subfamily A regulatory beta subunit 1
  ENST ID: ENST00000475456
  CDS Start-End: 21-552
acagatgctctttccatgccatgcagctgctgctgtggggtgggagaagggtggcatcggcaattcaccgctgtctttcctactctcttcactgcctttttcagcgatatgaagttaaaaccaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcga

SEQ ID NO: 168321 - DNA, 531 bp, Homo sapiens
  Payload ID: 13124
  Gene Symbol: KCNAB1
  Gene Name: potassium channel, voltage gated subfamily A regulatory beta subunit 1
  ENST ID: ENST00000472028
  CDS Start-End: 146-531
attccctttcaggatgctcctacagcagctgcctaatactctcagttgcagtcagatgttggctgggaccacagtcatctaaggatactgctcaagctggctgttgtctggaaactcagctggggctactgatcagagcacctgcatgtggctgtccagcaaggcaatgttaaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagaaattgtccgagccatgacacatgtgataaaccaaggcatggcgatgtactggggcacctc

SEQ ID NO: 168322 - DNA, 4437 bp, Homo sapiens
  Payload ID: 13124
  Gene Symbol: KCNAB1
  Gene Name: potassium channel, voltage gated subfamily A regulatory beta subunit 1
  ENST ID: ENST00000618897
  CDS Start-End: 1132-2046
aattcactggcgtgttccgcggcataagcaccccctctctgccttcccccagttccaactgttgtgctgcagcagatttggtctgagtctgggcagagcccctttttatggagcaaccctcccgatttgttacagcaagagcctggtgcaagtgatctttgccttcccatcgcacacaaaggcaaagagctccttaaagggacctgcctgctcctccgtgcagctgcaaacccgtgtcggtgcaggctcagcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggcaactgttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttagttatgtccttaagaaaaaattccacgcactcttattattttcttttctcttccaaaaagaattccctggcagagaatctatcattccaaaaggtaacct

SEQ ID NO: 168323 - DNA, 4273 bp, Homo sapiens
  Payload ID: 13125
  Gene Symbol: KCNAB2
  Gene Name: potassium channel, voltage gated subfamily A regulatory beta subunit 2
  Uniprot ID: Q13303
  ENST ID: ENST00000164247
  CDS Start-End: 565-1668
gaaatgcaaagcaggggctgtggggaaatctcaccaacccctcctcccctgggaggtggcaaaggtggtggactgggctgctgggaccctggggaggaatgaaacagaggctgtgttgatggcctgcagttccttgtaatgtggtcatcaaacggtgtacagttcccgtctgtggctgcaggctggagagctgactgctggcacagatacagcctgacctcgggtcaacacttctcggagtccagaggggttgggagtgggacaggtggcctcccagggacgcctccctgagtggccagtggtgccgcttgtccctgcacctgtagctgccctgagcacccccactggacacagtgggcattgcaccctccggagaaagctgcccttgttccacgtgcgagccctgtccccagcgccatgggctgtgctacctgcagtaacgcagactgcgagccccggctgcctctccagtgctctctctcctctggccttcagcaggctgggtcacagagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaaccc

SEQ ID NO: 168324 - DNA, 4165 bp, Homo sapiens
  Payload ID: 13125
  Gene Symbol: KCNAB2
  Gene Name: potassium channel, voltage gated subfamily A regulatory beta subunit 2
  Uniprot ID: Q13303
  ENST ID: ENST00000352527
  CDS Start-End: 486-1547
atcaccagaaccctctgccctgagaaaggggctcctgggccgacagggaaggtctgcctcctactctggaggggccgcttggggacaggcccgggctgtctcctcacagccacctgcttcctgtcctctgcctgtctcctgccccatctggccgctgctcatccaggaaggtcggagatgtcgggccctcccacctgggtcacgcgctaggcatgcctgagagcaaaggccacgccccgacaccccacggggccctggcgcgccaggcttctcagccctgcggcggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggtctctgtg

SEQ ID NO: 168325 - DNA, 4207 bp, Homo sapiens
  Payload ID: 13125
  Gene Symbol: KCNAB2
  Gene Name: potassium channel, voltage gated subfamily A regulatory beta subunit 2
  Uniprot ID: Q13303
  ENST ID: ENST00000341524
  CDS Start-End: 486-1589
atcaccagaaccctctgccctgagaaaggggctcctgggccgacagggaaggtctgcctcctactctggaggggccgcttggggacaggcccgggctgtctcctcacagccacctgcttcctgtcctctgcctgtctcctgccccatctggccgctgctcatccaggaaggtcggagatgtcgggccctcccacctgggtcacgcgctaggcatgcctgagagcaaaggccacgccccgacaccccacggggccctggcgcgccaggcttctcagccctgcggcggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggtctctgtg

SEQ ID NO: 168326 - DNA, 4142 bp, Homo sapiens
  Payload ID: 13125
  Gene Symbol: KCNAB2
  Gene Name: potassium channel, voltage gated subfamily A regulatory beta subunit 2
  Uniprot ID: Q13303
  ENST ID: ENST00000378083
  CDS Start-End: 290-1537
acttcccgagcttttaggggaagaggcactcgtgaataattcagcctctttcactgagatgaaaacgccctaatagaactaatggactcgctgcctcaaaactcgactctggtgggactcatctcattcaccaattgcttctgacgtcctgcagtgacactccctaatgaaaaagccgctgtgccagatccttagagtgtctggtgatccctaataaaccagactgtggcctttttaacgagcagacgcccccacgaaggcagtggcagctcccaagccaggcggcaccatgctgtccatgacgtacagcgagagtctgcggagcgtgagcagcaggtgccactctgaatgggccctgcaccccgtccgccagacggacacgctggaactgcagcggctgcgggaggtgcgggcggctgcccaggccaggaacatggagagcttcctccgcatgcacggcctttccctggacggctgcaccgcccagcgcacaggcatgaagtatcggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaaggggacccatttagttcctccaagtcaaggacattcatcatagaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaaccc

SEQ ID NO: 168327 - DNA, 1202 bp, Homo sapiens
  Payload ID: 13125
  Gene Symbol: KCNAB2
  Gene Name: potassium channel, voltage gated subfamily A regulatory beta subunit 2
  Uniprot ID: Q13303
  ENST ID: ENST00000378092
  CDS Start-End: 141-1202
agcgggattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaa

SEQ ID NO: 168328 - DNA, 4201 bp, Homo sapiens
  Payload ID: 13125
  Gene Symbol: KCNAB2
  Gene Name: potassium channel, voltage gated subfamily A regulatory beta subunit 2
  Uniprot ID: Q13303
  ENST ID: ENST00000378097
  CDS Start-End: 479-1582
ggaccgaggactggccgaggggcgcgccccgtccgctgccacccgcgggaggagcctcggaaggcggcgcaccgcgccgcacactcagtccaagaacccgcctcgcgtcactgtcgccgtcagggccgcggagccaatcagagcccaagtcgagggctgcgctttgcgagcgccagccaatcggtgcggcggcgggcccatcctgatttgcatgtccgacgacccctcaaccaatggtaatgtgactggcgtgaacaatagccaatcagaagctggaagaggcgtggccccgggcgtcccacgaggtgaagatgctgctggcggaacctgcaggagctagcgggattcgggggcgctaaagtcgcaggggcagggcgggaaggaagatccggcgcggggcacaggatccggagctggagcccccagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccagcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcgaggtggtgcccagggtgggcactgctgcttaatgcgaggcacacctggggcagctgagcccccaaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcgggaggaggtattgggtaggaccatccaagaaagggcagaagaccaagggcagtcggggtctagaaaggagggcgctggccctgctggacgcttcggagcccccactgtttcccactcagctttgtgctcagatcccaggtcccaaggagtgacaggggcttcctcccaccttctgtccttgtccagtcatgtaaataatgtgctttttctctccccgagtctttttttttaaacctaccgtggttcctcagctaactgcattccctacccaggcagagactgtcctatgcctcgagcttccaaacgagactcagaccgcgacacagccaccgtatttatggaatgacaaaataaataaagcccaaacccatcggtctctgtga

SEQ ID NO: 168329 - DNA, 822 bp, Homo sapiens
  Payload ID: 13125
  Gene Symbol: KCNAB2
  Gene Name: potassium channel, voltage gated subfamily A regulatory beta subunit 2
  ENST ID: ENST00000378111
  CDS Start-End: 144-665
agacgtccaccaaagccacacatcgcgacacacggaggcagaaagcagcggtctcctaagaagttagacacgaggaatctcgggcagcgagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgg

SEQ ID NO: 168330 - DNA, 959 bp, Homo sapiens
  Payload ID: 13125
  Gene Symbol: KCNAB2
  Gene Name: potassium channel, voltage gated subfamily A regulatory beta subunit 2
  ENST ID: ENST00000389632
  CDS Start-End: 199-959
agtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaa

SEQ ID NO: 168331 - DNA, 1336 bp, Homo sapiens
  Payload ID: 13125
  Gene Symbol: KCNAB2
  Gene Name: potassium channel, voltage gated subfamily A regulatory beta subunit 2
  Uniprot ID: Q13303
  ENST ID: ENST00000458166
  CDS Start-End: 153-1055
agagtgtctggtgatccctaataaaccagactgtggcctttttaacgagcagacgcccccacgaaggcaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtccttccgaaactgtcatcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagacca

SEQ ID NO: 168332 - DNA, 486 bp, Homo sapiens
  Payload ID: 13125
  Gene Symbol: KCNAB2
  Gene Name: potassium channel, voltage gated subfamily A regulatory beta subunit 2
  ENST ID: ENST00000445501
  CDS Start-End: 332-486
gggggcgctaaagtcgcaggggcagggcgggaaggaagatccggcgcggggcacaggatccggagctggagcccccagaggcctcacgacaggactagtgccttggtaagaagaggaaaaggccagagctccctccctaccctgtgtggacccagcaggaaggaattctgtctgcaagagagagccctcacctggaaccaaatcagccaggaccctgatgttggatttaccagcctccagcaccgtgagacagaaacgtctgctgtttcagccacccagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcct

SEQ ID NO: 168333 - DNA, 961 bp, Homo sapiens
  Payload ID: 13125
  Gene Symbol: KCNAB2
  Gene Name: potassium channel, voltage gated subfamily A regulatory beta subunit 2
  ENST ID: ENST00000428161
  CDS Start-End: 199-961
agtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagg

SEQ ID NO: 168334 - DNA, 536 bp, Homo sapiens
  Payload ID: 13125
  Gene Symbol: KCNAB2
  Gene Name: potassium channel, voltage gated subfamily A regulatory beta subunit 2
  ENST ID: ENST00000472700
  CDS Start-End: 1-488
agacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggatcttcgcggcgtctcagcctctccggagctcactgttcccatctgtaagaggaaacatcagaagcagttataaagttgggcctccctcctccctcccctcgaaatgccactcagaatcccagtgccaaggggagcccccgccccctcccccatggattcctgacaccccttcctcttgtcccatcaaatttgttttttggcaactctgatcccaaaacaaattcctcctcaccctgtaattaaacgaaattgcacgt

SEQ ID NO: 168335 - DNA, 683 bp, Homo sapiens
  Payload ID: 13125
  Gene Symbol: KCNAB2
  Gene Name: potassium channel, voltage gated subfamily A regulatory beta subunit 2
  ENST ID: ENST00000462676
  CDS Start-End: 1-369
tacgcagccggcaaggctgaagtggtactgggaaacatcattaagaagaaaggatggaggatcttcgcggcgtctcagcctctccggagctcactgttcccatctgtaagagggtgtgtgtgggaccgttccggcagggctatcctgagggtcagtggccccaagtctgtaaatcacccacccagctcagggcgggacgtgtcacactcctctgggaagtggtcccctccagcacagaccggggagcggtccccgggtgtgatggagcccaaaggtcgcagatcgggggccatccacccttctctcccaggagcctatgggcccttcccaggccaaggtcctcacccaccttgggaccaactgggctgagcacttgcctacattttgaggctccccagacccctggacacagctttatctcaaggtgctgacaagccccggggccctgttccttaataaatgcgtctttattttcagaaacatcagaagcagttataaagttgggcctccctcctccctcccctcgaaatgccactcagaatcccagtgccaaggggagcccccgccccctcccccatggattcctgacaccccttcctcttgtcccatcaaatttgttttttggcaactctgatcccaaaacaaattcctcctcaccctgtaattaaacgaaattgcacgta

SEQ ID NO: 168336 - DNA, 2396 bp, Homo sapiens
  Payload ID: 13125
  Gene Symbol: KCNAB2
  Gene Name: potassium channel, voltage gated subfamily A regulatory beta subunit 2
  Uniprot ID: Q13303
  ENST ID: ENST00000602612
  CDS Start-End: 179-1366
gctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgaagtggtactgggaaacatcattaagaagaaaggatggaggcggtccagcctcgtcatcaccaccaagatcttctggggcggaaaggcggagacggagcggggcctgtccaggaagcacataatcgaaggtctgaaagcttccctggagcgactgcagctggagtacgtggatgtggtgtttgccaaccgcccggaccccaacaccccgatggaagagaccgtccgcgccatgacccacgtcatcaaccaggggatggccatgtactggggcacgtcacgctggagctccatggagatcatggaggcctactccgtggcccggcagttcaacctgaccccgcccatctgcgagcaggctgagtaccacatgttccagcgtgagaaagtggaggtgcagctgccggagctgttccacaagataggagtgggcgccatgacctggtcccctctggcctgtggcattgtttctggcaagtacgacagtggcatcccaccctactcaagagcctccttgaagggctaccagtggctgaaggacaagatcctcagtgaggagggccggcgccagcaagccaagctgaaggagctgcaggccatcgccgagcgcctgggctgcaccctgccccagctggccatagcctggtgcctgaggaatgagggagtcagctccgtgctcctgggggcctccaatgcggaccagctcatggagaacattggggcaatacaggtaagagtgagaggccctgctgggcagagggcccatcccagcccgagccccgtccagtgcatcctcccaggctcgtcctgcgtgccaggctctgttctaggcactcaggatgcgcccgtgaaccatcagagttgtgctcctggagagcttgctttccagcaggaacagacatgaacactaactgcacgaaacaaggaggttagaatgtgtgtcagggtggacgagcgctgtaggagagaagccagagataaagggagggagctggggccagggacggtggcgctgcagactcaggttcaagggggcctgtcaggtgggcttgttgagaaggtggtgcttgagcagtcttgagagatgcggagtaagtcacgcaaatgcctgcgggaagaaccttccaccagcaggaagagttgatgcaaaggcccaaaaaggcctggagcagaggggcagatcctgagaggcacgaaacacctccagggacttctgagtgagacgggagccgtggcaaaattgtgggcagaggagggcgagctgcagctcagcctggaaagggaggctgctctccggctgctccatcggggaggctttgggaagcaaaagtcgaagcagagagccctggtgggaagtggcagctgcgggtccgagacgggagtggtggttggatcctggatgtttgggaaggtggggcccccgggactggctgacaaactggatgtgggggtgagaaggcgaggtggaagtcggtccccgggtgtgtcacccggaagggtggcggtgctgtatgctgaggcaggcgcagctggaaaaagcagtcacggacatggaagtccagcatttggcctggagtttccattttatgtcactgctgccaccacccttcaggaaggttctagggcaccttgacatttgagagggagtgcacagacccaggcatgcttcctctctgccccaaaccttctgaaacacaaaagcagcgtggcctccatctgcctcagatggagcccagatgtgatggggcaacccgggcctggccagccgaccatctggaagagcctggccccacctcctccccaggccaggcccgtcttgttggtgggattctgatttgttgttgttcttgcacgcaggtccttccgaaactgtcatcttccattatccacgagattgatagtattttgggcaataaaccctacagcaaaaagga

SEQ ID NO: 168337 - DNA, 2458 bp, Homo sapiens
  Payload ID: 13126
  Gene Symbol: KCNAB3
  Gene Name: potassium channel, voltage gated subfamily A regulatory beta subunit 3
  Uniprot ID: O43448
  ENST ID: ENST00000303790
  CDS Start-End: 1-1215
atgcaggtgtctatcgcgtgtaccgagcagaaccttcgcagccggagcagtgaggaccgtctgtgtggaccccggccgggccccgggggcggtaatggtgggccggccggcggggggcacgggaatcctccggggggtggagggtctggccccaaggcccgagctgcactggttccccgacccccagcgcccgctggggccctccgagagagcaccggccgaggcactggcatgaaatacaggaacctagggaagtctggtcttcgggtatcctgtcttggcctaggtacctgggtcacatttggttctcagatctcagatgagacagcagaggatgtgctgactgtagcctatgagcatggtgtaaacctgtttgacaccgccgaagtgtacgcagcaggaaaggctgaaagaaccctagggaacatcctcaagagcaaaggttggaggagatcaagctatgtcatcactaccaagattttttggggaggacaggcagaaaccgagcgaggtttaagccgaaagcacatcattgagggcttgcgaggatccctggaacgcctccagctgggatacgtggacattgtctttgccaatcgctcagaccccaactgtcctatggaggagattgtgcgagccatgacctatgtcatcaaccagggcctggccctatactgggggacatcccgatggggggctgcagaaatcatggaggcctactccatggccagacagttcaatctgattcctccagtgtgtgaacaagcggagcaccatctgtttcagagggagaaggtggagatgcagctgccagagctctaccacaagattggagttggatcagtcacttggtaccctctagcctgtggtctcattactagcaagtatgatgggcgagtcccagatacttgcagggcctccatcaagggctaccagtggctcaaggacaaagtgcagagtgaagatggcaagaagcaacaagccaaagtcatggaccttcttcctgtcgctcaccagctgggctgcaccgtggcccagcttgctattgcgtggtgtctccgcagtgagggtgtcagctctgtcttgctgggggtgtcgagtgcggagcagttgatagaacacctgggcgcgctacaggtgctgagccagctgaccccgcagacagtgatggaaatagacgggctcctgggaaacaagccgcattccaagaagtagtctgtcgcgggcgcagggacccaacccggtgtcgctgcacccgcccgagccccgctcctcgcagccgcctctcccgctccggatccctccacgcagcggccggagccagactagccccgcccaccaacgagtcccggcttcgagtagtgatacgcatgaacaaagccatatccttttgcagtggggtcgagagagaaagtagcacgcccgccccctgctgcgtctttctaggcccttcttgcaaatcccgggcatgagctactcgccgtcggctctctgccacttcgtctcgctccctactctcctccccttattcccgaggcccagaaaagaaaacaaaaacaaaaacccagcacatacaagaaacatacagtgtacctcaaaaggggcccttgaaatgtcatcaaagggtaataacctagtgagtgagttgtgatgtcatctggaacataggaaatggggctcttagcgtattcggtacgaaggaagccaggctggtcctggcaggaagtaaatgataatctttgggaaaccaggaccctgcctcccagcccagaggtggaggagggcggtcagggtggggtctacagtggcacagcactgacaaaggtagagggaaatgtaatagcacatctacgctgcagtctggtgaaagtggccggggtggtccttggaaaacagttgggctgttcttggcaggaattagtgacagcctttccgtcacgggcagggacgccttgatttaaaaaaaataaataaataaaacgtctgggtatagacttttgagccttgagcagggcctcctacctggcagtggggaactgcagtcttcctcctggcaataaacctaaagcaataatgatggccccttctctgtaagacttcccaggtaactgtaaataaacctcagcttgatcctcacagtgtctaaagttgcaggggcttgggaggttagggtcacagtctcacttgtctggccctctcgccccctaacattagaaatctgctagcattagctttctctccattgctcattcaccttggtgacccaggcatcgggctcctagtcactgttctcatcaaggaccaagacaccagataccccaggccccagttttcttccttcagctaccacattccttagaacccagaaatctggcttcataattttgttcctcctctttctatgaaagacttagctatctgcctttatttgtttgtatttaaagtaatattagccata

SEQ ID NO: 168338 - DNA, 2406 bp, Homo sapiens
  Payload ID: 13126
  Gene Symbol: KCNAB3
  Gene Name: potassium channel, voltage gated subfamily A regulatory beta subunit 3
  ENST ID: ENST00000570587
  CDS Start-End: 1-129
atgcaggtgtctatcgcgtgtaccgagcagaaccttcgcagccggagcagtgaggaccgtctgtgtggaccccggccgggccccgggggcggtcctcaatctgcctttcctccaggcccatctgcctagcctagccagggacccctgtctgtctgaatgcctgaacttgacttggtttacctcttccaacctgccatctaccatttggcacagcactctgcctgagggcctggtctcacaaactcaccacaatcaaacaaaattcctcccagcccctcactgcacacaacccacagatgactcaaacacagacaagaccccagaagaaggacaaaccagactgcacgtcttcaatgtgataagagggaatggagactctggacagtggctccagaggaacagtcacatatggttcacttgtccttttgagaaaattcctaggacctctgctctggagatagcacttgcccaatcttataggcccactgggtctaatttctttggactgagacacctgagggcttctcagtctggaaggagaggagctgggggctgataatctaagtccataatggaggctccaccccttcccgctgcttctgtatcttgcaggaacctagggaagtctggtcttcgggtatcctgtcttggcctaggtacctgggtcacatttggttctcagatctcagatgagacagcagaggatgtgctgactgtagcctatgagcatggtgtaaacctgtttgacaccgccgaagtgtacgcagcaggaaaggctgaaagaaccctagggaacatcctcaagagcaaaggttggaggagatcaagctatgtcatcactaccaagattttttggggaggacaggcagaaaccgagcgaggtttaagccgaaagcacatcattgagggctggagtgtaatggcacgatctcggctcactgcaacctcctcctcccgggttcaagggattctcctacctcagcgtctcgagtaactgggattacaggcacacgccaccacgcctggctaattttttgtatttttagtagaaatggggtttcaccacgttagccaggctggtctcaaactcctgacctcaggcttgcgaggatccctggaacgcctccagctgggatacgtggacattgtctttgccaatcgctcagaccccaactgtcctatggagggtaaaagcagcacccccaaaccttacagtccttcaaaactgagcacttccttgctgggtgcggtggctcattcctgtaatcccaggacgttgggaggccaaggcaggaggatcacttggggcctggagttcgagaacagtctgggcaacatagcaagaccctgtctctacaaaaaatgttttaaaattagctggctgtggtggtgtgtgccttgtactcccagctgttcaggaggctgaggcaggaggatcattcaagcccaggagtttgaggccacagtgagctatgattgcaccactgaactacatcctgagtgacagagtgagaccctgtctcaaaaaatctaaaatacaaaaattgagcacttcctcaaaccctcagcaggaagccagcccctgctcagaaggcctccaaaactccacagtggaggctgagactccaggatgtggacaggaagagaggcaaagaattgtgcgagccatgacctatgtcatcaaccagggcctggccctatactgggggacatcccgatggggggctgcagaaatcatggaggcctactccatggccagacagttcaatctgattcctccagtgtgtgaacaagcggagcaccatctgtttcagagggagaaggtggagatgcagctgccagagctctaccacaagattggagttggatcagtcacttggtaccctctagcctgtggtctcattactagcaagtatgatgggcgagtcccagatacttgcagggcctccatcaagggctaccagtggctcaaggacaaagtgcagagtgaagatggcaagaagcaacaagccaaagtcatggaccttcttcctgtcgctcaccagctgggctgcaccgtggcccagcttgctattgcgtggtgtctccgcagtgagggtgtcagctctgtcttgctgggggtgtcgagtgcggagcagttgatagaacacctgggcgcgctacaggtgctgagccagctgaccccgcagacagtgatggaaatagacgggctcctgggaaacaagccgcattccaagaagtagtctgtcgcgggcgcagggacccaacccggtgtcgctgcacccgcccgagccccgctcctcgcagccgcctctcccgctccggatccctccacgcagcggccggagccagactagccccgcccaccaacgagtcccggcttcgagtagtgatacgcatgaacaa

SEQ ID NO: 168339 - DNA, 1315 bp, Homo sapiens
  Payload ID: 13126
  Gene Symbol: KCNAB3
  Gene Name: potassium channel, voltage gated subfamily A regulatory beta subunit 3
  ENST ID: ENST00000570852
  CDS Start-End: 369-674
cgcgctgaagtggcatctctctcccgccccgcttccccctgggtccttatcctccgagacctttacctcatcctcgacctttaccctcatccatttccccctcctaatccttgctcctgtgtcccccgtaactgaatatctccactcctggcgccccccacgtttcttccctcccgccgcaaacctcgcgacctccagcagcccgcccccgcgggcccgatcctgcctggcggctcccgccgcagcctcctcagccttcccgctctgccggggttcgccccactacgcccccggtcgtcagccctcgggcttccctgctcccccctcccgtcccctcggagccccctcccccgcctcggccagccagcatgcaggtgtctatcgcgtgtaccgagcagaaccttcgcagccggagcagtgaggaccgtctgtgtggaccccggccgggccccgggggcggtaatggtgggccggccggcggggggcacgggaatcctccggggggtggagggtctggccccaaggcccgagctgcactggttccccgacccccagcgcccgctggggccctccgagagagcaccggccgaggcactggcatgaaatacaggtatgggggtggccgggcagcccaccccttccgctttcctttcgggacccctgagactgcttgagatggccgccaagaccccttcaaacttcactaagtcctcaatctgcctttcctccaggcccatctgcctagcctagccagggacccctgtctgtctgaatgcctgaacttgacttggtttacctcttccaacctgccatctaccatttggcacagcactctgcctgagggcctggtctcacaaactcaccacaatcaaacaaaattcctcccagcccctcactgcacacaacccacagatgactcaaacacagacaagaccccagaagaaggacaaaccagactgcacgtcttcaatgtgataagagggaatggagactctggacagtggctccagaggaacagtcacatatggttcacttgtccttttgagaaaattcctaggacctctgctctggagatagcacttgcccaatcttataggcccactgggtctaatttctttggactgagacacctgagggcttctcagtctggaaggagaggagctgggggctgataatctaagtccataatggaggctccaccccttcccgctgcttctgtatcttgcaggaacctagggaagtctggtcttcgggtatcctgtcttggcctaggtacctgggtcacatttggttctcagatctcagatgagacagc

SEQ ID NO: 168340 - DNA, 3347 bp, Homo sapiens
  Payload ID: 13127
  Gene Symbol: KCNE1
  Gene Name: potassium channel, voltage gated subfamily E regulatory beta subunit 1
  Uniprot ID: P15382
  ENST ID: ENST00000337385
  CDS Start-End: 401-790
cagctggcttttttcaaaccttagcaaccaccaaacagacaagcccttcggcctgtcctggagggcgttgaatggcatggcctggagctcaaccaggagaaccgtgctcaggaggaagagaccagaaggataactcaaaaagttctgagaagttcctaagaccacctgaagagaaggagcctgctgccaatggtgtggacaccgcagtgtgcttgaggagacttcagaaacgagaactggaaaaatccctctgctttctctggccagtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaacggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggaggacaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggagggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcacggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctatgcattcattagctaggacaacaatgcatttgcagtagtgagatttcgctaaaaaattaaagccatttactatgatc

SEQ ID NO: 168341 - DNA, 666 bp, Homo sapiens
  Payload ID: 13127
  Gene Symbol: KCNE1
  Gene Name: potassium channel, voltage gated subfamily E regulatory beta subunit 1
  Uniprot ID: P15382
  ENST ID: ENST00000399284
  CDS Start-End: 277-666
gagaaccgtgctcaggaggaagagaccagaaggataactcaaaaagttctgagaagttcctaagaccacctgaagagaaggagcctgctgccaatggtgtggacaccgcagtgtgcttgaggagacttcagaaacgagaactgtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatga

SEQ ID NO: 168342 - DNA, 1204 bp, Homo sapiens
  Payload ID: 13127
  Gene Symbol: KCNE1
  Gene Name: potassium channel, voltage gated subfamily E regulatory beta subunit 1
  Uniprot ID: P15382
  ENST ID: ENST00000399286
  CDS Start-End: 626-1015
gaaatcacaaattacaaaacgtcagagtactttctggaaataagccttcctctccagggaacaacgcatttgacacttgactgggatacactaccggatcctccgagggtgatggttctcaagaaggcagaagcaatggtgaccaatagacctccttaaaggctgagccgctgggcaccttcctactcctctcgaccgtgctaggatgactgcagcagagtccccgagtcctttgatgcaagggtctagcaaccaccaaacagacaagcccttcggcctgtcctggagggcgttgaatggcatggcctggagctcaaccaggagaaccgtgctcaggaggaagagaccagaaggataactcaaaaagttctgagaagttcctaagaccacctgaagagaaggagcctgctgccaatggtgtggacaccgcagtgtgcttgaggagacttcagaaacgagaactggaaaaatccctctgctttctctggccagtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtca

SEQ ID NO: 168343 - DNA, 3154 bp, Homo sapiens
  Payload ID: 13127
  Gene Symbol: KCNE1
  Gene Name: potassium channel, voltage gated subfamily E regulatory beta subunit 1
  Uniprot ID: P15382
  ENST ID: ENST00000399289
  CDS Start-End: 210-599
gggctgtctgtggcctcagcgctcggcaggcgcgcactcagctccacacccggctctctcggcatctcagacccggtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaacggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggaggacaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggagggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcacggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctatgcattcattagctaggacaacaatgcatttgcagtagtgagatttcgctaaaaaattaaagccatttactatga

SEQ ID NO: 168344 - DNA, 3184 bp, Homo sapiens
  Payload ID: 13127
  Gene Symbol: KCNE1
  Gene Name: potassium channel, voltage gated subfamily E regulatory beta subunit 1
  Uniprot ID: P15382
  ENST ID: ENST00000432085
  CDS Start-End: 238-627
gggctgtctgtggcctcagcgctcggcaggcgcgcactcagctccacacccggctctctcggcatctcagacccgggaaaaatccctctgctttctctggccagtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaacggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggaggacaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggagggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcacggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctatgcattcattagctaggacaacaatgcatttgcagtagtgagatttcgctaaaaaattaaagccatttactatgatc

SEQ ID NO: 168345 - DNA, 796 bp, Homo sapiens
  Payload ID: 13127
  Gene Symbol: KCNE1
  Gene Name: potassium channel, voltage gated subfamily E regulatory beta subunit 1
  Uniprot ID: P15382
  ENST ID: ENST00000416357
  CDS Start-End: 407-796
atttgcaggtgtctcgctcagcgcagctgcccagagccctgtgtcctgagtgatttccagtagattagcagctctgggtctaagcttttaagaaaaaaaaaaaattgcactacccttcagtaggggcagcattcacatctcacacccaggcagaagcagaaacggccaggaatccaccccactttctgggcctgacaaggccacagtttgagaacgttcagcacaggccaagcatcagatggattttgaacatctctggctcctaccatttctgcctccaccatccctttactcactgtgcaagctacaaaagctgaggggacaggaacaaggatgatttctgatggcatatttagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatga

SEQ ID NO: 168346 - DNA, 3222 bp, Homo sapiens
  Payload ID: 13127
  Gene Symbol: KCNE1
  Gene Name: potassium channel, voltage gated subfamily E regulatory beta subunit 1
  Uniprot ID: P15382
  ENST ID: ENST00000611936
  CDS Start-End: 276-665
caaaccttagcaaccaccaaacagacaagcccttcggcctgtcctggagggcgttgaatggcatggcctggagctcaaccaggagaaccgtgctcaggaggaagagaccagaaggataactcaaaaagttctgagaagttcctaagaccacctgaagagaaggagcctgctgccaatggtgtggacaccgcagtgtgcttgaggagacttcagaaacgagaactgaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaacggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggaggacaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggagggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcacggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctatgcattcattagctaggacaacaatgcatttgcagtagtgagatttcgctaaaaaattaaagccatttactatgatc

SEQ ID NO: 168347 - DNA, 3148 bp, Homo sapiens
  Payload ID: 13127
  Gene Symbol: KCNE1
  Gene Name: potassium channel, voltage gated subfamily E regulatory beta subunit 1
  Uniprot ID: P15382
  ENST ID: ENST00000621601
  CDS Start-End: 202-591
agtggcttcccccctggcaacctcaaactcccgcaggaaggaaaaatccctctgctttctctggccagtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcagtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaaggggtgaggggtggattaatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtgcccttaactaactttgtcctgcttcccagtggctggatgtggaggaggtggagagcagttatgagactgggaaagaacggggcactcaaagagccacacacatctgggcctgggcgacgtggatcctccttaccacccaccaggccagatttacaggagagagaaatccactccactcttccttaagccactgttattctgatctctgttaaggtcgcagaatcaatgcccttactgatacacctaccttataggactgaacctaaaggcatgacatttccatacttgtcacaagcacacactgattctgcccttgtcacttctgtgctcactcttgtggctctatcctcctcctgcccttccgccttccactcctcccttgcacccatcctgcacacatctccctgaaaacacacaggcacatacactcatatacatagacacacatacacacctcaatctagaaagaacttgctttgtacagggctgagatggaggagaaaaaaatgcccccttcagaatgcataccaaggggaaggtgctcggtcactgtgggagcagggaaaggtgcccccactccccgagagccaggggaaggagtggctctgggcagagagggacacatagcactggggtggcaggtccttttgaggtgatgggccggttttgtgagatgaattgtatcccccaaaaagacaggtaccttcaatgtgacctaattgggaaatagagtctttgcagatgatctagttgagatgaggtcattggggtgggccctcacccaatatgactggagtccttatcggaagagggaaattcagacacagatgcatagggaggacaccatgccgtgacagaggcagagggtgcagtgacacagccacaaaccaaggaaggccgaggatggatgcgcatccccatcccaagaagtcgggaagaagccaggaaggctcctctcccacaggtttcagaggaagcacagccctgcttgaattcaaacttttggcctccagaactgtgagtcagtacctgttgttgaagccacccagcttaggatactctggcagcctactgccatacagtattgggatactatagtgagcccatgcagcacctctcacccacccagagatggagctgctctgccttccagcggggcacccggagggctgccccagcagatagagagggcctccgttctgccacctgccttgaaagggtctccagctgccatatgtagcattggagtcctctgcaatgcgacatcctgaaagctcagctgcctgggcattcctgaagagtatggaatatttaaatgaaacatatttttttaaaacctgcgcataagataaaagcagcccgtgtgcatcttgggccatcctcaaatggacagacttggtcttgtgaggttccagtccttgtttcacataataaacactggcatggctcagcccctgagttaccacagtccttgagatgagtggttctttgggttacaaagtcctctgaaagtctagtgagagctgtgatctttgccccacccgaataatgcatatggacaccacaccttgcctgccgtgtccaggattcatgaccagtagcagcccagctatgcctgccacgtctcacggcccctgtgtaagccagacccttcttaggcagttgcatattcccagactgaggcagggcaggtttgcagagagagacccagagtgcacgtgacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctatgcattcattagctaggacaacaatgcatttgcagtagtgagatttcgctaaaaaattaaagccatttactatgatc

SEQ ID NO: 168348 - DNA, 1051 bp, Homo sapiens
  Payload ID: 13128
  Gene Symbol: KCNE2
  Gene Name: potassium channel, voltage gated subfamily E regulatory beta subunit 2
  Uniprot ID: Q9Y6J6
  ENST ID: ENST00000290310
  CDS Start-End: 141-512
gtaaggtgaaggtgcccagcaggctgaggcttgtgtgcaacccagaagagagctcgctaacgccagcaagaaggttcagaacagcctggctttggaaaggaatttcatcctgcccacacactgcatagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatgacccctaccaccagtacattgtagaggactggcaggaaaagtacaagagccaaatcttgaatctagaagaatcgaaggccaccatccatgagaacattggtgcggctgggttcaaaatgtccccctgataagggagaaaggcaccaagctaacatctgacgtccagacatgaagagatgccagtgccacgaggcaaatccaaattgtctttgcttagaagaaagtgagttccttgctctctgttgagaattttcatggagattatgtggttggccaataaagatagatgacatttcaatctcagtgatttatgcttgcttgttggagcaatattttgtgctgaagacctcttttactttccgggcaagtgaatgtcattttaatcaatatcaatgatgaaaataaagccaaatttgaagtaaagtgtctgggcagtggctgtggggatagaaaggagagatttacaaatcattgaatcttctttctcatgaaacatcatttgtgtgtgacaaattcaatttataaataacccagatgtattatgtagaagctgaggctcaaaagctatcacttgcttaccagacggacataggagcatttatctgtaatattaattcatgagtgtggagtctgaagagatgaataaacaaaccataagattacttta

SEQ ID NO: 168349 - DNA, 3143 bp, Homo sapiens
  Payload ID: 13129
  Gene Symbol: KCNE3
  Gene Name: potassium channel, voltage gated subfamily E regulatory beta subunit 3
  Uniprot ID: Q9Y6H6
  ENST ID: ENST00000310128
  CDS Start-End: 421-732
ggtgtgctggggcccgggcggggcagggggaggggacgcccgggggagggaaaagggagccgagcgcgggtgggagcccagagccagagagcgcgctgggcggtgctgggcacccgcggagtggaacggggctggtggaatgcacagggtcgcagcgcttgggccaccctcggtcagagggcgccgtgtccagcgagcaaacgggcgccccggagccttgctgagaggcagctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtgtgtctatgatctaacacgagagggctgggacggtggaagaccaagacacctggggattgcgtctggggcctccagaactctgctgtggactgcatcaggtctcagtgtccctatctgtaagatcaacaagaaacacggttaagggaggtcgtcactggggtgggagaagaggggctggtagaccgaagccttgtgcataaggattttttcccaggaaaagatagactttataaacagtgggagcccatgaacaaacatataaaagtagcaacagataatgaccaataactggttcagtggctggagtattaggggcctggggattggagaacggagaagaagttgtagcagagggaaatgagacaggaagatgctctggggacacattttttatgtgttatcttcagccatgagaagcagtgatgactatcccatatcacagatatgatttaccaccaccaccctgcccccgctcccgtgaagaaagcagggcaagtgctgtgctgcccatttgggcctgcatagtgccatgattggaacccaggaactctggtctccttgcctagtgcttttcaaaactctgtgctacacaggagtggatccaggcctgaaggtcatacaattctggggactctctttaagaaaaagaattctaaaatatcttacttttgcaaacattatgaaaatatactgccacattaatatgttgctagggcccctgctaggaccttaagaaggagctcatgtgagtcaggaccctgaatgttaggcctcgttagctctatggttcatatgcttcttgaaccaagtcacagggcacttcccagccacattgccaggcaacaggactaaactacctccaaagcaagcagtcttttcagttttgactgagtgatgtgagaaacttcttttcttttcttttctttttttttttttgagacagtctccctatgtcacccaggctgtggtgcagcaacccaatcttggctcactgcaacccccacctcccgggttcaagcaattatcctgcctcagccacctgagtagctgggattacaggttcctgtcaccacacccagttaatttatatatatatatatatatatatatttaagtagagacagggtttcacatgttgcccaggctggtctcgaactcctgtcctcaagttatctgcccattttggtctcccaaagtgctgggattacaagtgtaagccaccacgactatctgagagaagttttctgatgtcatgttgaatctgcttctaaaagactgatactgccaaggtgggcggatcacctgaggtcaggagttcgagaccagcctggccaacatggtgaaaccccatctactaaaaaaatacaaaaattagccagacctggtggcgggtgcccgtattcccagctacttgggaggctgaggcaggagaattgtttgaacccgggaggtggaggttgcagtaagccaagatcacgccactgcactccagcctgggtgacagagcaaggctctgtctcaaaaaaaaacaaaaacaaaaacaaaaaagactgatatcgcacctaaattattattatattaaaagaagcagagtatgagagacaggtacatggtccagtaggaagagaagcagccctgattctaccacttaaggtgatgtatgatcttaggctggacacttctctccctcatccgttttcctcttcaacataatgaaatagacttgaaagtctctaaggctctatcagttctgacattctaggcttcatatacattaagttgagccatatgtaatcactgtgtttgtaggttagaaacagctgagtatcgtagtttcatatatggttccagctaatacatgcaatgtggctggtgaacacttctgaattcagaaactatcccagatctcagctagaaccatccactgttctgtttgtccagtttcaacttaagggatctccatgcggtccctggaagtacccattgaaacatgcgtatttgtgtatagcagaactctgaaataatattctgacagcagttatctctgaggaattgggttataggtgattttccctttccgcatgataaatttatgtaatatttgactgacttgaccgtaagtatgttacttgtataataaaaggaaaaaaggtacttctattttgaaaaaataaaaataaaagcctttgggttcttgaatggaggatcatggaacacatttgctgccatatgcagttatgttgatgctctgcaaacctgtgctgagccctgttgctcaagcccttcctcatctcttcttgagggagaaggtggagacttccttaaggagatgtgacatatgggaagacaacagattcagaaatttacgtggataggactttagacaccacccagcccaaacttccaaataaaatatggaacgcaa

SEQ ID NO: 168350 - DNA, 585 bp, Homo sapiens
  Payload ID: 13129
  Gene Symbol: KCNE3
  Gene Name: potassium channel, voltage gated subfamily E regulatory beta subunit 3
  ENST ID: ENST00000532569
  CDS Start-End: 288-585
ccaggaagcaggcgctgcaggggacggaagggtcggagcccacagccgggggaggccaaggagctgggcggaggcactccaggccagcccggggagaactctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtg

SEQ ID NO: 168351 - DNA, 935 bp, Homo sapiens
  Payload ID: 13129
  Gene Symbol: KCNE3
  Gene Name: potassium channel, voltage gated subfamily E regulatory beta subunit 3
  Uniprot ID: Q9Y6H6
  ENST ID: ENST00000525550
  CDS Start-End: 454-765
tcacccagtgaagacactgtaagtctggaggtaggggacagcaatcagaggccctttggtcactgcacagttcctttaactgcaaccctaggctggcctgacccagctgctgcaggaaggggaggggccatgggagggggtcagagcccacagcaggactgttgcataatccttggggcctggccttgggcaatccaccctggttctgaagtttgtgctttgtgtctggttccttccttttctgccttctctcctgctttctagctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccgtgatgacaactcctacatgtacattctctttgtcatgtttctatttgctgtaactgtgggcagcctcatcctgggatacacccgctcccgcaaagtggacaagcgtagtgacccctatcatgtgtatatcaagaaccgtgtgtctatgatctaacacgagagggctgggacggtggaagaccaagacacctggggattgcgtctggggcctccagaactctgctgtggactgcatcaggtctcagtgtccctatctgtaagatcaacaagaaacacggttaagggaggtcgtcactggggtgggagaagaggggctggtagacc

SEQ ID NO: 168352 - DNA, 607 bp, Homo sapiens
  Payload ID: 13129
  Gene Symbol: KCNE3
  Gene Name: potassium channel, voltage gated subfamily E regulatory beta subunit 3
  ENST ID: ENST00000531854
  CDS Start-End: 450-607
agagccagagagcgcgctgggcggtgctgggcacccgcggagtggaacggggctggtggaatgcacagggtcgcagcgcttgggccaccctcggtcagagggcgccgtgtccagcgagcaaacgggcgccccggagccttgctgagaggcagatgcggacagaagctgaggcccagaaaagggaagtcttatgtccaaagtcacacaaggagcagctgagctgggacaactcccctggtttccatttccttcaccgtaaactctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcctacctggccg

SEQ ID NO: 168353 - DNA, 555 bp, Homo sapiens
  Payload ID: 13129
  Gene Symbol: KCNE3
  Gene Name: potassium channel, voltage gated subfamily E regulatory beta subunit 3
  ENST ID: ENST00000529425
  CDS Start-End: 407-555
cagagccagagagcgcgctgggcggtgctgggcacccgcggagtggaacggggctggtggaatgcacagggtcgcagcgcttgggccaccctcggtcagagggcgccgtgtccagcgagcaaacgggcgccccggagccttgctgagaggcagacactgaagacgctcattctgaaagagtagctgaaacggagtgacgggaaagaaagacccaaggctctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgagagcctgcatgccgtgctgaaggctctaaatgccactcttcacagcaatttgctctgccggccagggccagggctggggccagacaaccagactgaagagaggcgggccagcct

SEQ ID NO: 168354 - DNA, 550 bp, Homo sapiens
  Payload ID: 13129
  Gene Symbol: KCNE3
  Gene Name: potassium channel, voltage gated subfamily E regulatory beta subunit 3
  ENST ID: ENST00000526855
  CDS Start-End: 514-550
agagccagagagcgcgctgggcggtgctgggcacccgcggagtggaacggggctggtggaatgcacagggtcgcagcgcttgggccaccctcggtcagagggcgccgtgtccagcgagcaaacgggcgccccggagccttgctgagaggcagacactgaagacgctcattctgaaagagtagctgaaacggagtgacgggaaagaaagacccaaggatgcggacagaagctgaggcccagaaaagggaagtcttatgtccaaagtcacacaaggagcagctgagctgggacaactcccctggtttccatttccttcaccgtaaactctgggctttcccagctccgaagtcaatactgagatcccagatgtgtccagagacatcctgaagaggctcgggggtggaggagccttagtgtgtccacaaagggactcctgaaactgactgagagccagtggatttgccagcagtctgagcttctaccgagtcttcccccacctcaatccctgttgctatggagactaccaatggaacggagacctggtatgaga

SEQ ID NO: 168355 - DNA, 3291 bp, Homo sapiens
  Payload ID: 13130
  Gene Symbol: KCNE4
  Gene Name: potassium channel, voltage gated subfamily E regulatory beta subunit 4
  Uniprot ID: Q8WWG9
  ENST ID: ENST00000281830
  CDS Start-End: 332-997
attatgggattcagctgcctctgaaaacctgtagcccaataatggttattccccaggagccgcgcgaagcatgagctaattttcagtgagcgcggactttggggtaacggttccagcacagcacatccctttctcctcttttcactcatcgtcaccgctacctgaaaaccctggccgggtgctggggcttgaggagcagttcccacttcccagtctttttcacttttcacagctgcaaagttcagggagttgaactgcagtgctttcagttcactgctcactctgccacgatcaatctctgttgtaaattttcctcccagagcacgtgacgatgcacttcttgactatatatcccaactgcagcagcggagttgtcagagcgcagagccggacagagcagaagaaccctcttggactggacgatttgggaattcaaaacttgggacaaactgtcagccttgcccctgctgtggaggcagcctcaatgctgaaaatggagcctctgaacagcacgcaccccggcaccgccgcctccagcagccccctggagtcccgtgcggccggcggcggcagcggcaatggcaacgagtacttctacattctggttgtcatgtccttctacggcattttcttgatcggaatcatgctgggctacatgaaatccaagaggcgggagaagaagtccagcctcctgctgctgtacaaagacgaggagcggctctggggggaggccatgaagccgctgcctgtggtgtcgggcctgaggtcggtgcaggtgcccctgatgctgaacatgctgcaggagagcgtggcgcccgcgctgtcctgcaccctctgttccatggaaggggacagcgtgagctccgagtcctcctccccggacgtgcacctcaccattcaggaggagggggcagacgatgagctggaggagacctcggagacgcccctcaacgagagcagcgaagggtcctcggagaacatccatcagaattcctagcacccccgggacccctgccggtggctccatcagccagcaaccttagagagaggaaagacagttttcaagtgtctggtttcactttcacagtgcggctgccactttgaagagacccttggtaaacccctgattcggggtggggtgggggactaggctcagccggaaccagcacctccaaggagtccgggaggtgcctgtggtttgcacccaccactgaaaaagccgcggagatgcgcagcgcgtacactgactttggggcctgggtgttggggttctgatcagaatttggcgggatgatatgtttgccattttctcactggatgccctgggtagctcctgcagggtctgcctgttcccagggctgccgaatgcttaggacacgctgagagactagttgtgatttgctattttgcctagagctttgtccttctagatctgattggctgtaagtatctctactgtgtacctgtggcattccttcacagtgggttacaagcttcttttggattagagggggatttttgatgggagaaagctggagatctgaacccagcccatttgcacactataagaaaaaaaagtaacttttaaacctgttaacattggccggggttataagagatgatcttctattttgaccttttgtctaacttatgaccttgaactctgacctgtgaccatgcagcatcacatgatggcatgacgttctttggatcagaagagcttccccagaatctaacctgcactcccgatggtggttcaggagactcttcctgatctttctagaaggggtaaagtggggttgaacaaggccaagccgttagctctgctgctgctcagtttcccagcctagttttctgagctgggagaggacataatgtggtatttcgtcacgtagctgagacctagaagggcatactcaggcggagattgcacaaagctgggctccaagttctgtgcttcctgatcccgagccctgacactcatttgctgtgtggtcccgggcatgtcatcaagaagctcgctgtctgcatgaggctcccgacgatctccatccccagggggttgggaggatgtctttagattttaggactctgtgataaatattccacagcctggtgtgaggaagcttggaccaaatgcttcccctttggccggttagtctgaacaaggatctgctgatttaaaggagcagttggagattcagaacacatataactggggaattcagggcaagctaccaacccagccctgctgtagttttcccaggactgaaggaaagaggcagacaccacattctcctctgcaaagttctctggagaatgtgtgatgttaacactcccagctaagggaaagcaaagtctaaaggaaaacacacaggaatgcttccaatgtctccaagtattcctgtggtcaacagtttcgcagatccgttaggcccttaaagacaaggaggaagtaaaaggtcaaatttaaatctatttaaaaaaacttttaaaaaaattatttatttattattattttttatttttaagacagaatctcgctctgttgcccaggctggagtgcagtggtgcaatcttggctcactgcaacctccacctcctgggtttcagcgattctcctgcctcagcctcctgagtagctgggattacaggcgcctgccaccacgcccagctaattttttgatttttagtagagatggggtttcgccattttggccaggctggtctcaaactcctggccttaaatgatcctcccacctcggcctcccaaagtgctgggattacaggcatgagccactgcacccggccactttttttttttttaaagaaaaatgctctgcatggattggagacacagcaataactactgttgccatggaagggttaacagtgtaggagctggtttatcagtccgctttgacatacagctaaaggaaatttatgtttgggggaaaaaggccctctgttcactttaaaattcagtgtggacttatgccaaagggggctgtttaagttgaaagaagccaagttaagtttggcctcttgcctggaatcacttgaattctgaaatttcactgcgacggacatgtgccttgtcacattttccattgcttaatcctgaagtttggtgcaagtctctctgcacctattaaaaagtgatgtatatacttccttcttattctgttgagttgtatagaattgtcttttgtatttaacactttgtaattttcacaatattttttaatttaaataaataaacacattttttccctcctgggaagtcatgaa

SEQ ID NO: 168356 - DNA, 1473 bp, Homo sapiens
  Payload ID: 13131
  Gene Symbol: KCNE5
  Gene Name: potassium channel, voltage gated subfamily E regulatory beta subunit 5
  Uniprot ID: Q9UJ90
  ENST ID: ENST00000372101
  CDS Start-End: 153-581
agccactgcgcgctcgccggagagctgggtgctaccgctgtttccgctgctgagccctgcccgccggccggcccgctcgctagctcgcttcccctcgcccagggggaaaggtcagcagcgtcctggagccgccgtgtcactccccgaaagccatgaactgcagcgagagccagcggctgcgaacccttctgagccgcctgttgctcgagctgcaccaccggggtaatgccagcggcttgggcgctggccctcgtcccagcatgggcatgggggtcgtgcctgaccctttcgtgggccgcgaggtgaccagcgccaagggcgacgacgcctatctctacatcctgctcatcatgatcttctacgcctgcttggccggaggcctcatcctggcctacacccgctcccgtaagctcgtcgaggccaaggacgagccgtcccaggcttgcgccgagcacgaatgggccccgggaggcgccctgaccgccgacgccgaggctgccgcgggctcccaggccgagggccgccgccagcttgcctccgaggggctgcctgccctcgcccagggcgctgagcgggtctaaaaccacagccccagattgctggttcgcgccctcctcatctcgctcatccctgggcgcgcctcccaccttccacccccaactcccttccagggttcgcctcatctgaggcccagataatggtgagaggccaggagaccttgtctggaaggccctggaaggagaagcaccaccttacccattcgggccagtttctccctcttcacccctgcgcctccacccctaccccgcacatccaactgcactaaactgcctctgctctcttgtcttcagacagccctgacagcacgctccagccctctgggaactgaatccaacacgtccaacacttggcactgaactgaagcaatgcattctatcagaactctgggccgtctaactggcagctgctccaggggctgccagggactgctcactctgcagagccaacgggcttgccaggccgactgcagcagctccagcttccagttgccttagggacagagacaaaggaaatgaagagacctcagacatcttttccctccctctctctttcagcagggagctagcaggacactaggaccagtctgtgggatagaatgaacttaatgggggacggaagggggaggagtgctcaacggggagggaaatgatctatgactccaaccgtatgattttcttgcctccccagttttcatcccagtggtaacgcctgatttttggtagctatgccatcttctgctgaggattaccattactgggtgtatcaccccagtacttccaaatgcctctcctctattgattcagttgttattgcagtgtctgcttcatccgtggaacttgaggctcagatgccccctgctctgtaaccctggggaatgtcagaggcaggtaataaaggttgtttaaacaataa

SEQ ID NO: 168357 - DNA, 4237 bp, Homo sapiens
  Payload ID: 13132
  Gene Symbol:
  Gene Name: Potassium voltage-gated channel subfamily A member 6  [Source:UniProtKB/Swiss-Prot
  Acc:P17658]
  Uniprot ID: P17658
  ENST ID: ENST00000280684
  CDS Start-End: 867-2456
aagcttactggtgaggcaagtgtgcgtctatttccatggcgccctggctcgcggcagcccctggctgggcgaggggtgtgatgtgggagtggggtgggagggggcagcaggcggggcctgccacgtcacttggagagtgtgtgttgggaaggaagggcagagcggagagccgagccgctgcagctgcggcggcggcagcgaagccttgagccgtggggaggtgggtccccgcgctcgggcgccggggcagccccgggccctctgcgaggcctgcggcgcggctcctagggaggaggtggcggctgtggcggccggaaccgcgaccttggccggacccagccccgcggtggacgcagggcggaggccgagccccgccaggagtctttgccgagccggagggaggcgcatctggcgcttcggtaccagcggcagccgggggtccggagcggctggaggagcgcagtgggaactgggaagagctagcccggctggagggcggacctctgcgtccgggagccgggtctcaggcaccgctgggggcgaagccacgcgtcttttcgggcagccaatttcacacgcgcctgtgtgcggttccgggcatcccagtaagctctagcacccgggcgcgggtaacgggaagcgcagaaccaaatccccagcgcccaggtcacctccccagacccagccttgcagggaccagggctttagggctcacggacccaacggccaggtcagaccgcgaaccgggaggagcgcgggccccaccctaaagagggcgcagccgggagctggggagcgggtgccgcgctccagagattgtgtcgtgggcgccgtcctagtggcggggagcgcacctccgagggggcatgagatcggagaaatcccttacgctggcggcgccgggggaggtccgtgggccggagggagagcaacaggatgcgggagacttcccggaggccggcgggggcgggggctgctgtagtagcgagcggctggtgatcaatatctccgggctgcgctttgagacacaattgcgcaccctgtcgctgtttccggacacgctgctcggagaccctggccggcgagtccgcttcttcgaccccctgaggaacgagtacttcttcgaccgcaaccggcccagcttcgacgccatcctctactactaccagtctgggggccgcctgcggaggccggtcaacgtgcccctggacattttcctggaggagatccgcttctaccagctgggggacgaggccctggcggccttccgggaggacgagggctgcctgcccgaaggtggcgaggacgagaagccgctgccctcccagcccttccagcgccaggtgtggctgctctttgagtacccagagagctctgggccggccaggggcatcgccatcgtctccgtgttggtcattctcatctccatagtcatcttttgcctggagaccttaccccagttccgtgtagatggtcgaggtggaaacaatggtggtgtgagtcgagtctccccagtttccagggggagtcaggaggaagaggaggatgaagacgattcctacacatttcatcatggcatcacccctggggaaatggggaccgggggctcctcctcactcagtactcttgggggctccttctttacagaccccttctttctggtggagacgctgtgcattgtctggttcacttttgagctcctggtgcgcttctccgcctgccctagcaagccggccttcttccggaacatcatgaacatcattgacttggtggctatcttcccctacttcatcaccctgggcactgagctggtgcagcagcaggagcagcaaccagccagtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacgatgacgattcgctttttcccagcatcccggatgccttctggtgggcagtggttacaatgaccacggtaggttacggggacatgtaccccatgactgtggggggaaagatcgtgggctcgctgtgtgccatcgctggggtcctcaccattgccctgcctgtgcccgtcatcgtctccaacttcaactacttctaccaccgggagacggagcaggaggagcaaggccagtatacccacgtcacttgtgggcagcctgcgccggacctgagggcaactgacaacggacttggcaagcctgacttccccgaggctaaccgggaacggagacccagctaccttcctacaccacatcgggcctatgcagagaaaagaatgctcacggaggtctgacccatgcaggcagggcctgcaggaggggagcactgagctaacagtctcttaggcttccttctcatttccactactcactctagcttcagttgacttcttgactctctcccctacacccactacctggcatccaggaccaaatacctggactatcaaccttgttgcttaatccctgcagcattcaaggttaatccatctaagtgacatttttgaaattccagcggtgccacccaatcatgcccagcttctgtcatatgaatgagatatacatttatgtctgaccttccctcaagactgatttttcatgtctgggacttacaatatctcaaggaacagcaatgtcaacaggatggaaaccagccctatctgagtcttcgctccctccttagtgttctttgctttgggtcatgtgcgtttcctagcttcaggctacttggtaactggaagaagctggaggacagaagcagtactcaacttgctgttattccagtgccctgtaacaatcactggtcctcctgcagatgacccttggtagagtctttatttgcatagcctcaaaataggttattcgtttctaaacttggatggaattagagaatacaatcaaactttaccacttggaggacacggggttagtccaggaccaaagaggccaatggatttttcaaagtgtgccccagcacaagaggcactggtgttcggtctacatttagttctccccactctgatcccctgactctccagcttccaggaaggttccttctcagagccaaatactctttgtgcaagtgccttcctgagcagaagaactggagaaagggaaccacagagccaggaggaatgtctgagcagagtcaagcaactggcttgaccacagtctgaagcaaggtgccacttaaacagatactgttttctcaaaggggcagaggaatcgtgttgcagatggcagccttttctccttcattttccccacattttctctggccctctaccttgcttcctgggagtttgatttaggattgctgttgaaggcttcctcaggcaaactccagcttaaagccctagacaggtaaaagcacacattggatggcagcatgggtttcttcccattttatgggcatgaaatatgtggtttagaataaggaacaagcattattcctttgccaacagcctcactctaagaggcttttttgctgagtcaagcaaacacttgcctgctctgccccttggagctgcatttgacctgctctcactggtaaggtgacttggtggcgttcccacttgatttagccattttcttccattgtgagaccactgccatctatccacctgcccacctccccttttgtttctcagtaacattgccatttgttttttgcctttgataaactgtgatgtactgttctgagatcttttgggtgcagttctgaaactgaaaggactgttaacatgtttttaattttatatctatgctttcagactctttgatgataattttttttttaaaaattattctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttag

SEQ ID NO: 168358 - DNA, 4538 bp, Homo sapiens
  Payload ID: 13133
  Gene Symbol: KCNS1
  Gene Name: potassium voltage-gated channel, modifier subfamily S, member 1
  Uniprot ID: Q96KK3
  ENST ID: ENST00000306117
  CDS Start-End: 398-1978
ggcagcgatcgatgcggccttcagccgcgggggactaggcaaggaagaaggaaggagagggcagcggggccgcctgcagcaggaggctcggcggggccggcggggcagaggcgagaccgagtatagccagcggctcccagcctcggtggctttgggacagacacgcgaggcgcccgggaggtgccaccacaggtggagatccaagtggaggtgggagcggagctacatcacacgtttattgtgcattgattatgtgccagggaccatgctgccgataaacaccttgcatcatttaattctctgagcctctcctggaaagtatgatgctacccggttccacagacagggaaacaagcccagagagggcgacgaatgcactcaaggacagcagctagtgatgctgatgctgctggtccggggaacacactatgagaacctccggtctaaagtggtgctgccaacacccctaggagggaggagcactgaaacctttgtgagcgagttcccgggccccgacaccgggatccgctggcggcgaagcgacgaggcgctgcgcgtgaacgtgggtggcgtgcggcggcagctgagcgcgcgcgccctggcgcgcttcccgggcacgcggctgggccgcctgcaggccgcggcgtcggaggagcaggcgcggcgcctgtgcgacgactacgacgaggcggcgcgcgaattctacttcgaccggcacccgggcttcttcctgagcctgctgcacttctaccgcactggccacctgcacgtgctcgacgagctgtgcgtcttcgcctttggccaggaggccgactactggggcctaggcgagaacgcgcttgccgcgtgctgccgcgcgcgctacctggagaggcggctgacccagccgcacgcctgggacgaggacagcgacacgccgagcagcgtggacccgtgccccgacgagatctccgacgtgcagcgagaactggcgcgctatggcgcggcgcgctgtggccgcctgcgccgccgcctctggctgaccatggagaacccgggctactcgctgccgagcaagctcttcagctgcgtctccatcagcgtggtgctcgcctccatcgccgccatgtgcatccacagcctgcccgagtaccaggcccgcgaggcggcggccgccgtggctgcggtggccgcgggccgcagcccggaaggcgtgcgcgacgacccggtgctgcgacgcctcgagtacttctgcatcgcctggttcagcttcgaggtgtcgtcgcgcctcctgctggcgcccagtacgcgcaacttcttctgccacccgctcaacctcatcgacattgtgtctgtgctgcccttctatctcacgctgctggctggtgtggcactgggcgaccagggcggcaaggagttcggccacctgggcaaggtggtgcaggtgttccgcctcatgcgcatcttccgcgtactcaagttggcgcgccattccaccgggctgcgctcgctgggagccacgctcaagcacagctaccgtgaggtgggcatcttgctgctgtacctggctgtgggtgtgtcagtgttctctggtgtggcctacacagctgaaaaggaggaggacgtgggctttaacaccatcccagcctgctggtggtggggcacagtgagcatgaccaccgtgggctatggggatgtggtgccagtgacggtggctggcaagctggcagcctcaggctgcatcctagggggcatcctggtggtagcactccccatcaccatcatcttcaacaagttctcccacttctaccggcgccagaaggctctggaggcagccgtgcgcaacagcaaccaccaagagtttgaggacttgctgagcagcattgatggggtgtcggaggcatctctggagacatcccgagaaacctctcaggagggacagtctgcagatctagagagccaggcccccagtgagcctccacaccctcagatgtattaaaaccagggatccgtgaccccctgccatgcccctacagtagagattcctcccctgctaaagttcttcatggtagtgagcctcccaggatcactcatgctgtcctgagaaatgagattcaaaagctgcattccttcctccaaaggcccaggacaggacagtgctaccctagattctgtgagattctgcaagcaactcagaaagctttataaacctgcctccaagccattcatgaagcaggcatgagccagagggaggaagttgaaaggatactaatgattcctgagcacctcctgtacatgaaccaggtcatgtttggccttgtgttggagaaagagaattatccccacttcacagatgaggaaaccaaggctaagagatgagcgatgcctctcccagatgtcacaattagaagtggcagagtcaggtttggaatctgggcttgttggtgtgcctggagcaatgctccatcaactccatctttcttctgccctcatgaagtttgcgtgtgttttttggtgattcatggatccccagagttgatccacaagataagaaatccctttcagagccagggaagggtccagacaggagatttggatataggagctctggatctcagctgtggttcctttctaggagcatccaacaggagtcagcaatcaaagatgagtcctggagggaaggaggatgagtcctgggaggaagtaccatagcattgtacttgcctctttagctggtatgcaagatttgctaagcaataatcttccgaccttcctcccagggctgatgtgagagaaagaaaatctgaagggcccctggcctgagatctagacaacctagctgcgccaagacctgctgtgtaaagtggtccaatccctgcccccaagtccagattccagcccctctgtcaaatggtcagaatctgtgacccagagggcaatgaaagccaaggagagcagaggggtctctaacttaaagccagctcagctctgaaatgttcagagggctgacatatatgaatactggcttctaagaccctcccccaacagtctgaccttggcagttcctttctgcccatcacacagacgtccagccctacattgtccagccctacctagagtacccatccaggcccatgtgtgagagtcctctcccttctggccagctccagccccctcacccttgctgggggcatatctctcatacccacctgctgaatcttctcttcacttgctgagaaagtcagaggaggggatccagtagccctttccacatactgtggctacagcacccagcactgtgctgttgttgtctgactgtggctatctctgtcccatcaccctgagcctcaagatggaagacattgtctgcttgaactctgggcttggtgcagagtaggtatttggtaaatgttgaatagatcaaccaattcctacagcccactgggtgccaagctcagagggggaaaaaaagatagccagagagagacctggccctcaaaaaggtgtgaacaagactgaaaaggaggtccgttcagctccgcctgccctgtccctgcttggttcttgaagtttttacaatatattccttgtaggttcttcactcactcactcaacaaatacccgttggaagagtcttaaactggggcttcatgtgtggcctgcagtcatgtttcggcttagtccaacagtgtttttattatattttaagaatctgaatgcctttgcgtgaggcatgcactctcaggttccccatagtgtctcccccgctgccacccacaaacagacacacatgccgttgtgttatgcccagccactctgatatactggcttctgacttatgggctgcttactagtctcaagagatacagtggtggaaaaatatatccctatactcatgaagcttaccgactagtagggaagatagactctaatgcaataatcacataaatatagcgagctctactaagtacaggtgtgtataatgtatcagggaccatggcccgagaaagtgagaaggctttcctgagcaagtgacaatctaacctgccatccaaatgataaattgctaattaagcaaatgaggttccaggggggagtactccaagcagagagaatggcatgtgtgaaggtgtgtgtcatacacagggcctagtacatagtgggccccctacatacgcatggattctgggtctccagattggaacagaggatggagctaagcagcaaagggcctcccttgaattcaccacacacataccagcccttctgcacactctgctccttacatctaggcccagctgaacccaggttaggggcagatcagaagggctgcgtgtagcacccttatggtcttgcagaacacaccaagaaacccgacggcttccatattttctgaccctacaaacaggtccctaatactgatgtggagaaagctcaagagggaatcatctggcctgagcctaccatgaggctgtttgtggtcctggcagaaaagcaacaactcgctccccttcccatgtatcagtgaaaaccattatgcaaataaagagctgggcccc

SEQ ID NO: 168359 - DNA, 2136 bp, Homo sapiens
  Payload ID: 13133
  Gene Symbol: KCNS1
  Gene Name: potassium voltage-gated channel, modifier subfamily S, member 1
  Uniprot ID: Q96KK3
  ENST ID: ENST00000537075
  CDS Start-End: 51-1631
gtggctttgggacagacacgcgaggcgcccgggaggtgccaccacaggtgatgctgatgctgctggtccggggaacacactatgagaacctccggtctaaagtggtgctgccaacacccctaggagggaggagcactgaaacctttgtgagcgagttcccgggccccgacaccgggatccgctggcggcgaagcgacgaggcgctgcgcgtgaacgtgggtggcgtgcggcggcagctgagcgcgcgcgccctggcgcgcttcccgggcacgcggctgggccgcctgcaggccgcggcgtcggaggagcaggcgcggcgcctgtgcgacgactacgacgaggcggcgcgcgaattctacttcgaccggcacccgggcttcttcctgagcctgctgcacttctaccgcactggccacctgcacgtgctcgacgagctgtgcgtcttcgcctttggccaggaggccgactactggggcctaggcgagaacgcgcttgccgcgtgctgccgcgcgcgctacctggagaggcggctgacccagccgcacgcctgggacgaggacagcgacacgccgagcagcgtggacccgtgccccgacgagatctccgacgtgcagcgagaactggcgcgctatggcgcggcgcgctgtggccgcctgcgccgccgcctctggctgaccatggagaacccgggctactcgctgccgagcaagctcttcagctgcgtctccatcagcgtggtgctcgcctccatcgccgccatgtgcatccacagcctgcccgagtaccaggcccgcgaggcggcggccgccgtggctgcggtggccgcgggccgcagcccggaaggcgtgcgcgacgacccggtgctgcgacgcctcgagtacttctgcatcgcctggttcagcttcgaggtgtcgtcgcgcctcctgctggcgcccagtacgcgcaacttcttctgccacccgctcaacctcatcgacattgtgtctgtgctgcccttctatctcacgctgctggctggtgtggcactgggcgaccagggcggcaaggagttcggccacctgggcaaggtggtgcaggtgttccgcctcatgcgcatcttccgcgtactcaagttggcgcgccattccaccgggctgcgctcgctgggagccacgctcaagcacagctaccgtgaggtgggcatcttgctgctgtacctggctgtgggtgtgtcagtgttctctggtgtggcctacacagctgaaaaggaggaggacgtgggctttaacaccatcccagcctgctggtggtggggcacagtgagcatgaccaccgtgggctatggggatgtggtgccagtgacggtggctggcaagctggcagcctcaggctgcatcctagggggcatcctggtggtagcactccccatcaccatcatcttcaacaagttctcccacttctaccggcgccagaaggctctggaggcagccgtgcgcaacagcaaccaccaagagtttgaggacttgctgagcagcattgatggggtgtcggaggcatctctggagacatcccgagaaacctctcaggagggacagtctgcagatctagagagccaggcccccagtgagcctccacaccctcagatgtattaaaaccagggatccgtgaccccctgccatgcccctacagtagagattcctcccctgctaaagttcttcatggtagtgagcctcccaggatcactcatgctgtcctgagaaatgagattcaaaagctgcattccttcctccaaaggcccaggacaggacagtgctaccctagattctgtgagattctgcaagcaactcagaaagctttataaacctgcctccaagccattcatgaagcaggcatgagccagagggaggaagttgaaaggatactaatgattcctgagcacctcctgtacatgaaccaggtcatgtttggccttgtgttggagaaagagaattatccccacttcacagatgaggaaaccaaggctaagagatgagcgatgcctctcccagatgtcacaattagaagtggcagagtcaggtttggaatctgggcttgttggtgtgcctggagcaatgctccatcaactccatctttcttctgccctcatgaagtttgcgt

SEQ ID NO: 168360 - DNA, 5219 bp, Homo sapiens
  Payload ID: 13134
  Gene Symbol: KCNS2
  Gene Name: potassium voltage-gated channel, modifier subfamily S, member 2
  Uniprot ID: Q9ULS6
  ENST ID: ENST00000287042
  CDS Start-End: 351-1784
cacggggcgaatgcggcgcgggttcctgcctctctgggtgggtgaggggcgcgcggatccggagagggggctccgggagcggcgggaccacgcagccacctgtgagccttcggcagctgcgggcggcggcggcgtacccggcccgagacgggaggagacgctcggcggcccccgcccgccggcccgccgggcgcacacactcgcacccgcgcacgcaccgccagcaggcagcggccaccgccgcgatgctcgcccgcgggttggggaagtttcccgccggcctcggccgcgggcacccgtgctcccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctggagctctgcgatgactacgacgacgtccagcgggagttctacttcgaccgcaaccctgagctcttcccctacgtgctgcatttctatcacaccggcaagcttcacgtcatggctgagctatgtgtcttctccttcagccaggagatcgagtactggggcatcaacgagttcttcattgactcctgctgcagctacagctaccatggccgcaaagtagagcccgagcaggagaagtgggacgagcagagtgaccaggagagcaccacgtcttccttcgatgagatccttgccttctacaacgacgcctccaagttcgatgggcagcccctcggcaacttccgcaggcagctgtggctggcgctggacaaccccggctactcagtgctgagcagggtcttcagcatcctgtccatcctggtggtgatggggtccatcatcaccatgtgcctcaatagcctgcccgatttccaaatccctgacagccagggcaaccctggcgaggaccctaggttcgaaatcgtggagcactttggcattgcctggttcacatttgagctggtggccaggtttgctgtggcccctgacttcctcaagttcttcaagaatgccctaaaccttattgacctcatgtccatcgtccccttttacatcactctggtggtgaacctggtggtggagagcacacctactttagccaacttgggcagggtggcccaggtcctgaggctgatgcggatcttccgcatcttaaagctggccaggcactccactggcctccgctccctgggggccactttgaaatacagctacaaagaagtagggctgctcttgctctacctctccgtggggatttccatcttctccgtggtggcctacaccattgaaaaggaggagaacgagggcctggccaccatccctgcctgctggtggtgggctaccgtcagtatgaccacagtggggtacggggatgtggtcccagggaccacggcaggaaagctgactgcctctgcctgcatcttggcaggcatcctcgtggtggtcctgcccatcaccttgatcttcaataagttctcccacttttaccggcgccaaaagcaacttgagagtgccatgcgcagctgtgactttggagatggaatgaaggaggtcccttcggtcaatttaagggactattatgcccataaagttaaatcccttatggcaagcctgacgaacatgagcaggagctcaccaagtgaactcagtttaaatgattccctacgttagccgggaggacttgtcaccctccaccccacattgctgagctgcctcttgtgcctctggcacagcccaggcaccttatggttatggtgtaaggagtatgcccagcccctgaggggagagatgcatgggatatgcacccaggtttcttttacagtttttagaatcgtttttagagggtggtgtgtctgacaccatgcctttgcacctttccatgaaatgacactcactggtctttgcatcgtgggcataaaatgttcacctttttgccagatgagtacacccagaatgctaatttttctgtccatcgtgtacgctattctagtgcttgtggcccagtactgtctatgagttgtcgtgctcctgtttctgaggttgtcgtgtgagttctgtacaaaaagcccccacaagtcgtccagtagaaatgcatctatgaggtcagcaaggatatgatgagattttgctcacagtcatgtgaaaacaaaatctcagctctttatccattgctttcacttagttttagtaccaaaacaaagagaatgcaaagttaagcagacttgaccaatgcaagtctctaagttgtttttataaatgatctgtagttccgtggcttgcatgggtgcaccaatcatctttagaacgatgtacactgatgttcatctcataaatgtcactctttagagaatgttacttagttaaacatgcagtgaagatcgaatttttttcccaagaacagatgtgttagggagaggggcttcagctaaatagtccaaaccctagggtgcttaaagccaagttagtgcaggctgagccccttggttcacagtcaagcctccttgtttcctagggtgactgtagagaaatgtatttccggatgaggtttctgatctaggccatttgaccaaactttgctgtgtctaagatattagcatgtttttgaaatatttattttttaagatgtttaggagtaaggtcgtgttgtcttcctcaactaaaaagaagtttactgttgtatcgtctccctgaggtgaacgttgttgggttgctagcaagggcagtagcttaaatacttttgttgcctactctgaaagctcatcaaatgagagcccttttatttccaagcagaatttagtcagataattttgcttctaggatatagtatgttgtatatgatgctgtgattgccctggagttcctgccatgacatggaaacctggtggtatggaagcatgtactcaaaatatagacgtgcacgatggtggtgtggcttacccaggatggaaacactgcagttcttacttgcattcccactgcctttcatggggggtgactgggtagaggccaggagaaaggaaagagttgtaaaataaaaaactgctagttcataaaatgtcataaaaaattgtaaacttgaaaagcttaatgctattcaaaagaccttcaagcttccaaacttgtattgaagggagacgactgtttcctcctccaaaatgctcctgctcctcttgttcggttaaccagcacataacattgtgatggggaacctgggttcctctataagataattcttctccatcatctttaaggtaatctgatggttttccaggtggctttcattattgttccatctttgaaaaggcaatagaacccaggggtctgagcatggagctatccagggttttcatccaaaggttgggcctcttcttaagaggtccttttgtgtttcagttgattgaagatgatacttacctcattggaggtgtggcaaggatcttatcagaaggctttgtgttcttgtagttgtcatggctactacagtgtgggtgatttattgaatgaattcactagccacttgtgtcctggagcccccagttcaaatctttccattggactggaggcttgtgggaggctgggaggtggctgtctcctagtgtctacatccgtgtctctgaagcatcaggaaaagtgagatgacttagaggcaactgggcactgaatcagaggagcagagttatttttcagaatttgcacatggaacacttagatttggctggtgcttccagccctggaaggcataacatttacggactcatccccagctgcactgaaggcaggtggtggtacagacttatgaggacggatcagtttgccaaggctgatggtattgggtcactgagcctggtatccatggccgctgaccaggaagcttatgcaaagtggaagcaaggaacaaggcagaataactcagtcactttcatgaagatttttctaaacaagaaggcttaccaccaaaaaagaggtaccctagtggttaccctttgcagatgtgaaagctggaaaacttgacttttctttttggtaatgacttgcatttatctggtgcctttcgttggaggaatcccaacgtgctttagagactatctttttaacatctcttgtacatacatatatacttatataaaatattatcttgcccaactggacctttactcacttctgagcatgagaatgtcccaatagcattgagtttttcaagtggtggtttcagataagtgggagaaagaacaacccggctggcttaaaccctggagctaattcccacaaggaatgtagactgaatggtgacccagggagaaataatcttcctctcccctaaagtctcactaaggtttgaagtttacaggtgctctccactgggtctttgatcgaccttgctagataacatctaaccagcagtttcttttagtccctgaagctaaccagggagagtcaggttaattttctgtaaaaatatgaggtgacatctttggcaaccaggctgtcagactgacctgtaaacctcctttagggggacagagtagaaactggagatgacttgtttccagctgtgagcttgagagaagtgtcactcccagcatttgaaggttattgttttcaatgccagtgggccaaatatatgggccaggctttgatatctgtgatgtgcattttggaagtgctgggttgggaagtgacacgtctgttgcacaaatgcatattggttataggtttgtgttttctgccaaacccccacatttctcgggtttgtgagtgaggaagggcatgttgtaatgccaagctgatttgtagctcgtaaggtagtaattggtatttaacatttgcatttgttatttctacttatcttagcactcaaataattgaactacctgctaattcttgccgcatttcaaagaaaataagttgttatgcactttgggatagtggtgatctgtacaggctgtgtgttagctacttgaaggcgtaactggtatttcttgtgtgttttaacagcatgacttcttacagagctgtaatttttaaaattgaggatgccatatttgagatgtcagttttaacactcattaacacactactgtgcaagcattgacacaggctgcactg

SEQ ID NO: 168361 - DNA, 4340 bp, Homo sapiens
  Payload ID: 13134
  Gene Symbol: KCNS2
  Gene Name: potassium voltage-gated channel, modifier subfamily S, member 2
  Uniprot ID: Q9ULS6
  ENST ID: ENST00000521839
  CDS Start-End: 172-1605
tcccccccaccccaccaaagctacgcgccccccgtgtcggcccggccctgcccgtgcgtatctcagctccggtcccgcctgtctgcggcgagcgggcgggggcgtctcccgggcctgcccatggacaaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctggagctctgcgatgactacgacgacgtccagcgggagttctacttcgaccgcaaccctgagctcttcccctacgtgctgcatttctatcacaccggcaagcttcacgtcatggctgagctatgtgtcttctccttcagccaggagatcgagtactggggcatcaacgagttcttcattgactcctgctgcagctacagctaccatggccgcaaagtagagcccgagcaggagaagtgggacgagcagagtgaccaggagagcaccacgtcttccttcgatgagatccttgccttctacaacgacgcctccaagttcgatgggcagcccctcggcaacttccgcaggcagctgtggctggcgctggacaaccccggctactcagtgctgagcagggtcttcagcatcctgtccatcctggtggtgatggggtccatcatcaccatgtgcctcaatagcctgcccgatttccaaatccctgacagccagggcaaccctggcgaggaccctaggttcgaaatcgtggagcactttggcattgcctggttcacatttgagctggtggccaggtttgctgtggcccctgacttcctcaagttcttcaagaatgccctaaaccttattgacctcatgtccatcgtccccttttacatcactctggtggtgaacctggtggtggagagcacacctactttagccaacttgggcagggtggcccaggtcctgaggctgatgcggatcttccgcatcttaaagctggccaggcactccactggcctccgctccctgggggccactttgaaatacagctacaaagaagtagggctgctcttgctctacctctccgtggggatttccatcttctccgtggtggcctacaccattgaaaaggaggagaacgagggcctggccaccatccctgcctgctggtggtgggctaccgtcagtatgaccacagtggggtacggggatgtggtcccagggaccacggcaggaaagctgactgcctctgcctgcatcttggcaggcatcctcgtggtggtcctgcccatcaccttgatcttcaataagttctcccacttttaccggcgccaaaagcaacttgagagtgccatgcgcagctgtgactttggagatggaatgaaggaggtcccttcggtcaatttaagggactattatgcccataaagttaaatcccttatggcaagcctgacgaacatgagcaggagctcaccaagtgaactcagtttaaatgattccctacgttagccgggaggacttgtcaccctccaccccacattgctgagctgcctcttgtgcctctggcacagcccaggcaccttatggttatggtgtaaggagtatgcccagcccctgaggggagagatgcatgggatatgcacccaggtttcttttacagtttttagaatcgtttttagagggtggtgtgtctgacaccatgcctttgcacctttccatgaaatgacactcactggtctttgcatcgtgggcataaaatgttcacctttttgccagatgagtacacccagaatgctaatttttctgtccatcgtgtacgctattctagtgcttgtggcccagtactgtctatgagttgtcgtgctcctgtttctgaggttgtcgtgtgagttctgtacaaaaagcccccacaagtcgtccagtagaaatgcatctatgaggtcagcaaggatatgatgagattttgctcacagtcatgtgaaaacaaaatctcagctctttatccattgctttcacttagttttagtaccaaaacaaagagaatgcaaagttaagcagacttgaccaatgcaagtctctaagttgtttttataaatgatctgtagttccgtggcttgcatgggtgcaccaatcatctttagaacgatgtacactgatgttcatctcataaatgtcactctttagagaatgttacttagttaaacatgcagtgaagatcgaatttttttcccaagaacagatgtgttagggagaggggcttcagctaaatagtccaaaccctagggtgcttaaagccaagttagtgcaggctgagccccttggttcacagtcaagcctccttgtttcctagggtgactgtagagaaatgtatttccggatgaggtttctgatctaggccatttgaccaaactttgctgtgtctaagatattagcatgtttttgaaatatttattttttaagatgtttaggagtaaggtcgtgttgtcttcctcaactaaaaagaagtttactgttgtatcgtctccctgaggtgaacgttgttgggttgctagcaagggcagtagcttaaatacttttgttgcctactctgaaagctcatcaaatgagagcccttttatttccaagcagaatttagtcagataattttgcttctaggatatagtatgttgtatatgatgctgtgattgccctggagttcctgccatgacatggaaacctggtggtatggaagcatgtactcaaaatatagacgtgcacgatggtggtgtggcttacccaggatggaaacactgcagttcttacttgcattcccactgcctttcatggggggtgactgggtagaggccaggagaaaggaaagagttgtaaaataaaaaactgctagttcataaaatgtcataaaaaattgtaaacttgaaaagcttaatgctattcaaaagaccttcaagcttccaaacttgtattgaagggagacgactgtttcctcctccaaaatgctcctgctcctcttgttcggttaaccagcacataacattgtgatggggaacctgggttcctctataagataattcttctccatcatctttaaggtaatctgatggttttccaggtggctttcattattgttccatctttgaaaaggcaatagaacccaggggtctgagcatggagctatccagggttttcatccaaaggttgggcctcttcttaagaggtccttttgtgtttcagttgattgaagatgatacttacctcattggaggtgtggcaaggatcttatcagaaggctttgtgttcttgtagttgtcatggctactacagtgtgggtgatttattgaatgaattcactagccacttgtgtcctggagcccccagttcaaatctttccattggactggaggcttgtgggaggctgggaggtggctgtctcctagtgtctacatccgtgtctctgaagcatcaggaaaagtgagatgacttagaggcaactgggcactgaatcagaggagcagagttatttttcagaatttgcacatggaacacttagatttggctggtgcttccagccctggaaggcataacatttacggactcatccccagctgcactgaaggcaggtggtggtacagacttatgaggacggatcagtttgccaaggctgatggtattgggtcactgagcctggtatccatggccgctgaccaggaagcttatgcaaagtggaagcaaggaacaaggcagaataactcagtcactttcatgaagatttttctaaacaagaaggcttaccaccaaaaaagaggtaccctagtggttaccctttgcagatgtgaaagctggaaaacttgacttttctttttggtaatgacttgcatttatctggtgcctttcgttggaggaatcccaacgtgctttagagactatctttttaacatctcttgtacatacatatatacttatataaaatattatcttgcccaactggacctttactcacttctgagcatgagaatgtcccaatagcattgagtttttcaagtggtggtttcagataagtgggagaaagaacaacccggctggcttaaaccctggagctaattcccacaaggaatgtagactgaatggtgacccagggagaaataatcttcctctcccctaaagtctcactaaggtttgaagtttacaggtgctctccactgggtctttgatcgaccttgctagataacatctaaccagcagtttct

SEQ ID NO: 168362 - DNA, 2333 bp, Homo sapiens
  Payload ID: 13135
  Gene Symbol: KCNS3
  Gene Name: potassium voltage-gated channel, modifier subfamily S, member 3
  Uniprot ID: Q9BQ31
  ENST ID: ENST00000304101
  CDS Start-End: 381-1856
cgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggagtactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacaccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccgacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatggagaa

SEQ ID NO: 168363 - DNA, 2397 bp, Homo sapiens
  Payload ID: 13135
  Gene Symbol: KCNS3
  Gene Name: potassium voltage-gated channel, modifier subfamily S, member 3
  Uniprot ID: Q9BQ31
  ENST ID: ENST00000403915
  CDS Start-End: 452-1927
agtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggagtactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacaccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccgacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagta

SEQ ID NO: 168364 - DNA, 553 bp, Homo sapiens
  Payload ID: 13135
  Gene Symbol: KCNS3
  Gene Name: potassium voltage-gated channel, modifier subfamily S, member 3
  ENST ID: ENST00000419802
  CDS Start-End: 331-553
agggaagagcgaacccagggcccttgctctcgtgcagcgctgcgccctgggtggggacggcgtgaggcttgcagcgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggagtactactttgatcggaatccctcct

SEQ ID NO: 168365 - DNA, 1478 bp, Homo sapiens
  Payload ID: 13136
  Gene Symbol: POTEB
  Gene Name: POTE ankyrin domain family, member B
  ENST ID: ENST00000435397
  CDS Start-End: 34-939
ctactaccggcctcccctggctgttaaaagcagatggtggctgaggtttgttcaatgcccgctgcctctgctgtgaagaagccatttgatctcaggagcaagatgggcaagtggtgccaccaccgcttcccctgctgcagggggagcggcacgagcaatgtgggcacttctggagaccatgacgactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacaggaagtggtgaaatttttaatcaagaaaaaagctaatttaaatgcacttgatagatatggaagaatttgtgaattactttctgactataaagaaaaacagatgctaaaaatctcttctgaaaacagcaatccagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaagagcagaaaacctgaaaatcagcaatttcctgacactgagaatgaagagtatcacagtgacgaacaaaatgatacccagaaacaactttctgaagaacagaacactggaatatcacaagatgagattctgactaataaacaaaagcagatagaagtggctgaaaaggaaatgaattctgagctttctcttagtcataagaaagaagaagatctcttgcgtgaaaacagcatgttgcgggaagaaattgccaagctaagactggaactagatgaaacaaaacatcagaaccagctaagggaaaataaaattttggaggaaattgaaagtgtaaaagaaaaacttctaaagactatacaactgaatgaagaagcattaacgaaaaccagtatttaagtacagtggacagcttagg

SEQ ID NO: 168366 - DNA, 1706 bp, Homo sapiens
  Payload ID: 13136
  Gene Symbol: POTEB
  Gene Name: POTE ankyrin domain family, member B
  ENST ID: ENST00000439682
  CDS Start-End: 53-1687
ggtagacgcgatctgttcgctactaccggcctcccctggctgttaaaagcagatggtggctgaggtttgttcaatgcccgctgcctctgctgtgaagaagccatttgatctcaggagcaagatgggcaagtggtgccaccaccgcttcccctgctgcagggggagcggcacgagcaatgtgggcacttctggagaccatgacgactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacaggaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacagccagagagtatgctgtttctagtcatcatcatgtaatttgtgaattactttctgactataaagaaaaacagatgctaaaaatctcttctgaaaacagcaatccagaacaagacttaaagctgacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaagagcagaaaacctgaaaatcagcaatttcctgacactgagaatgaagagtatcacagtgacgaacaaaatgatacccagaaacaactttctgaagaacagaacactggaatatcacaagatgagattctgactaataaacaaaagcagatagaagtggctgaaaaggaaatgaattctgagctttctcttagtcataagaaagaagaagatctcttgcgtgaaaacagcatgttgcgggaagaaattgccaagctaagactggaactagatgaaacaaaacatcagaaccagctaagggaaaataaaattttggaggaaattgaaagtgtaaaagaaaaacttctaaagactatacaactgaatgaagaagcattaacgaaaaccagtatttaagtacagtggacagcttagg

SEQ ID NO: 168367 - DNA, 1478 bp, Homo sapiens; identical to SEQ ID NO: 168365
  Payload ID: 13137
  Gene Symbol: POTEB2
  Gene Name: POTE ankyrin domain family, member B2
  ENST ID: ENST00000438063
  CDS Start-End: 34-939

SEQ ID NO: 168368 - DNA, 1687 bp, Homo sapiens
  Payload ID: 13137
  Gene Symbol: POTEB2
  Gene Name: POTE ankyrin domain family, member B2
  Uniprot ID: H3BUK9
  ENST ID: ENST00000454856
  CDS Start-End: 34-1668
ctactaccggcctcccctggctgttaaaagcagatggtggctgaggtttgttcaatgcccgctgcctctgctgtgaagaagccatttgatctcaggagcaagatgggcaagtggtgccaccaccgcttcccctgctgcagggggagcggcacgagcaatgtgggcacttctggagaccatgacgactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacaggaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacagccagagagtatgctgtttctagtcatcatcatgtaatttgtgaattactttctgactataaagaaaaacagatgctaaaaatctcttctgaaaacagcaatccagaacaagacttaaagctgacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaagagcagaaaacctgaaaatcagcaatttcctgacactgagaatgaagagtatcacagtgacgaacaaaatgatacccagaaacaactttctgaagaacagaacactggaatatcacaagatgagattctgactaataaacaaaagcagatagaagtggctgaaaaggaaatgaattctgagctttctcttagtcataagaaagaagaagatctcttgcgtgaaaacagcatgttgcgggaagaaattgccaagctaagactggaactagatgaaacaaaacatcagaaccagctaagggaaaataaaattttggaggaaattgaaagtgtaaaagaaaaacttctaaagactatacaactgaatgaagaagcattaacgaaaaccagtatttaagtacagtggacagcttagg

SEQ ID NO: 168369 - DNA, 1820 bp, Homo sapiens
  Payload ID: 13138
  Gene Symbol: POTEB3
  Gene Name: POTE ankyrin domain family, member B3
  ENST ID: ENST00000615774
  CDS Start-End: 49-1794
gacgcgatctgttcgctactaccggcctcccctggctgttaaaagcagatggtggctgaggtttgttcaatgcccgctgcctctgctgtgaagaagccatttgatctcagaagcaagatgggcaagtggtgccaccaccgcttcccctgctgcagggggagcggcaagagcaacatgggcacttctggagaccacgacgactcctttatgaagacgctcaggagcaagatgggcaagtgttgccatcactgcttcccctgctgcagggggagcggcacgagcaatgtgggcacttctggagaccatgacaactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacaggaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctgacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaagagcagaaaacctgaaaatcagcaatttcctgacactgagaatgaagagtatcacagtgacgaacaaaatgatacccagaaacaactttctgaagaacagaacactggaatatcacaagatgagattctgactaataaacaaaagcagatagaagtggctgaaaaggaaatgaattctgagctttctcttagtcataagaaagaagaagatctcttgcgtgaaaacagcatgttgcgggaagaaattgccatgctaagactggaactagatgaaacaaaacatcagaaccagctaagggaaaataaaattttggaggaaattgaaagtgtaaaagaaaaacttctaaaggctatacaactgaatgaagaagcattaacgaaaaccagtatttaagtacagtggacagcttaggattttga

SEQ ID NO: 168370 - DNA, 1813 bp, Homo sapiens
  Payload ID: 13138
  Gene Symbol: POTEB3
  Gene Name: POTE ankyrin domain family, member B3
  Uniprot ID: A0JP26
  ENST ID: ENST00000611217
  CDS Start-End: 49-1794
gacgcgatctgttcgctactaccggcctcccctggctgttaaaagcagatggtggctgaggtttgttcaatgcccgctgcctctgctgtgaagaagccatttgatctcaggagcaagatgggcaagtggtgccaccaccgcttcccctgctgcagggggagcggcaagagcaacatgggcacttctggagaccacgacgactcctttatgaagacgctcaggagcaagatgggcaagtgttgccaccactgcttcccctgctgcagggggagcggcacgagcaatgtgggcacttctggagaccatgacaactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctgacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaagagcagaaaacctgaaaatcagcaatttcctgacactgagaatgaagagtatcacagtgacgaacaaaatgatacccagaaacaactttctgaagaacagaacactggaatatcacaagatgagattctgactaataaacaaaagcagatagaagtggctgaaaaggaaatgaattctaagctttctcttagtcataagaaagaagaagatctcttgcgtgaaaacagcatgttgcgggaagaaattgccatgctaagactggaactagatgaaacaaaacatcagaaccagctaagggaaaataaaattttggaggaaattgaaagtgtaaaagaaaaacttctaaaggctatacaactgaatgaagaagcattaacgaaaaccagtatttaagtacagtggacagcttagg

SEQ ID NO: 168371 - DNA, 1989 bp, Homo sapiens
  Payload ID: 13138
  Gene Symbol: POTEB3
  Gene Name: POTE ankyrin domain family, member B3
  ENST ID: ENST00000612601
  CDS Start-End: 372-1517
agtagctttgcctggtgtttcttgcttggattggcgtttcctccctcgcattcctttgctggacttgaccttttctctgctgggtttggcattcccttgactgggctgggtgtttccttgggagggggggcttggcctttcctggggtgggcgtggggtccccctggtgggcgtgggctttccccgggtgggtgtgggttttccctgggtggggtgggctgggctcccttgctgggcttggcaagttttggctgggattgacctttctcttcaaacagattggaaacccagggtttcctgctagttggtgaaactggttggtagacgcgatctgttcgctactaccggcctcccctggctgttaaaagcagatggtggctgaggtttgttcaatgcccgctgcctctgctgtgaagaagccatttgatctcaggagcaagatgggcaagtggtgccaccaccgcttcccctgctgcagggggagcggcaagagcaacatgggcacttctggagaccacgacgactcctttatgaagacgctcaggagcaagatgggcaagtgttgccaccactgcttcccctgctgcagggggagcggcacgagcaatgtgggcacttctggagaccatgacaactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccaggtaaagaagcagaagaataatttttggcagaaggaacatgcaacaagtttgtgtgtttgccagaagaacatctgatgagattgcctgtttggcaggaagagcaacaactgcaaaagacaggatgccgagtgaactttgcagggtttctgagcagttcacttttgctagtaccaaaagtgtgagacaccagagtttgggaatgaggtgaatacttagctaagtgtgaaagccaccatgattatatgtaagcaaacaggcatgactgagctcctataaaactttatttacaaagccaaaaggcagattggatttgtcctgtggcctatagtttgctgggattgatggaagataaccatgtaaagaaaccaggagacaaaggaagcttttgcagtagtcatctatagtttccatgtcacacatccttggactagtatcaatgtattctaaggttttcacctgcccatggtgaaataaagtttggaatccccatta

SEQ ID NO: 168372 - DNA, 1989 bp, Homo sapiens
  Payload ID: 13138
  Gene Symbol: POTEB3
  Gene Name: POTE ankyrin domain family, member B3
  ENST ID: ENST00000617395
  CDS Start-End: 372-1517
agtagctttgcctggtgtttcttgcttggattggcgtttcctccctcgcattcctttgctggacttgaccttttctctgctgggtttggcattcccttgactgggctgggtgtttccttgggagggggggcttggcctttcctggggtgggcgtggggtccccctggtgggcgtgggctttccccgggtgggtgtgggttttccctgggtggggtgggctgggctcccttgctgggcttggcaagttttggctgggattgacctttctcttcaaacagattggaaacccagggtttcctgctagttggtgaaactggttggtagacgcgatctgttcgctactaccggcctcccctggctgttaaaagcagatggtggctgaggtttgttcaatgcccgctgcctctgctgtgaagaagccatttgatctcagaagcaagatgggcaagtggtgccaccaccgcttcccctgctgcagggggagcggcaagagcaacatgggcacttctggagaccacgacgactcctttatgaagacgctcaggagcaagatgggcaagtgttgccatcactgcttcccctgctgcagggggagcggcacgagcaatgtgggcacttctggagaccatgacaactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacaggaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccaggtaaagaagcagaagaataatttttggcaggaggaacatgcaacaagtttgtgtgtttgccagaagaacatctgatgagattgcctgtttggcaggaagagcaacaactgcaaaagacaagatgccgagtgaactttgcagggtttctgagcagttcacttttgctagtaccaaaagtgtgagacaccagagtttgggaatgaggtgaatacttagctaagtgtgaaagccaccatgattatatgtaagcaaacaggcatgactgagctcctataaaactttatttacaaagccaaaaggcagattggatttgtcctgtggcctatagtttgctgggattgatggaagataaccatgtaaagaaaccaggagacaaaggaagcttttgcagtagtcagctatagtttccatgtcacacatccttggactagtatcaatgtattctaaggttttcacctgcccatggtgaaataaagtttggaatctccgtta

SEQ ID NO: 168373 - DNA, 2855 bp, Homo sapiens
  Payload ID: 13138
  Gene Symbol: POTEB3
  Gene Name: POTE ankyrin domain family, member B3
  ENST ID: ENST00000624267
  CDS Start-End: 441-1595
acctgtaacgggtacacttcgcttcgcgttcctcgcttggccttgcgttcctagcttggcttggctgttagtagctttgcctggtgtttcttgcttggattggcgtttcctccctcgcattcctttgctggacttgaccttttctctgctgggtttggcattcccttgactgggctgggtgtttccttgggagggggggcttggcctttcctggggtgggcgtggggtccccctggtgggcgtgggctttccccgggtgggtgtgggttttccctgggtggggtgggctgggctcccttgctgggcttggcaagttttggctgggattgacctttctcttcaaacagattggaaacccagggtttcctgctagttggtgaaactggttggtagacgcgatctgttcgctactaccggcctcccctggctgttaaaagcagatggtggctgaggtttgttcaatgcccgctgcctctgctgtgaagaagccatttgatctcaggagcaagatgggcaagtggtgccaccaccgcttcccctgctgcagggggagcggcaagagcaacatgggcacttctggagaccacgacgactcctttatgaagacgctcaggagcaagatgggcaagtgttgccaccactgcttcccctgctgcagggggagcggcacgagcaatgtgggcacttctggagaccatgacaactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaagagcagaaaacctgaaaatcagcaatttcctgacactgagaatgaagagtatcacagtgacgaacaaaatgatacccagaaacaactttctgaagaacagaacactggaatatcacaagatgagattctgactaataaacaaaagcagatagaagtggctgaaaaggaaatgaattctaagctttctcttagtcataagaaagaagaagatctcttgcgtgaaaacagcatgttgcgggaagaaattgccatgctaagactggaactagatgaaacaaaacatcagaaccagctaagggaaaataaaattttggaggaaattgaaagtgtaaaagaaaaacttctaaaggctatacaactgaatgaagaagcattaacgaaaaccagtatttaagtacagtggacagcttaggattttgacaactgagaatgctcagttctgaactggagaatgtaagacacagctaggaaacactggaaatggaaattcaatcatgtcattgtagactgactactgctctacatgattgtgatcaaagtcagatagctgaaagggacttctttccagagaacaaacatcaacaggtttatttacaggagaaaatgaattcttatatatctcacctaaaagataacagtgagattctttctgaacaactctaacgctgacagtaaaattaacaacctaaaaattaagctccatcacacaggataaattctgagagaaaagatgaggcaggccaccatctttcctgtttgggcaacttagtcattccagcgtgcgggctttggagagtacaaactcaccagggacagaagagatcctgtggcatagcacagctgctttaccaaatcatggccagaatgcttctgtaagcaggcccctgatcctgttcctcgtcactggacaggatctcccacctgaggcctccagctacacccaccagtgttccctggccaatggagatttgaaaccttcctgggacagagttcccagagagaggggtgggccatgatgggcaggtcttcctggcctgggtctccagccagccccccacttgagccttcaagccagtagcaactcagcaactccctggacagagcttccaggagcaacagaaatcctctctgcca

SEQ ID NO: 168374 - DNA, 2855 bp, Homo sapiens
  Payload ID: 13138
  Gene Symbol: POTEB3
  Gene Name: POTE ankyrin domain family, member B3
  ENST ID: ENST00000630023
  CDS Start-End: 441-1595
acctgtaacgggtacgcttcgcttggcgttcctcccttggccttgcgttcctagcttggcttggctgttagtagctttgcctggtgtttcttgcttggattggcgtttcctccctcgcattcctttgctggacttgaccttttctctgctgggtttggcattcccttgactgggctgggtgtttccttgggagggggggcttggcctttcctggggtgggcgtggggtccccctggtgggcgtgggctttccccgggtgggtgtgggttttccctgggtggggtgggctgggctcccttgctgggcttggcaagttttggctgggattgacctttctcttcaaacagattggaaacccagggtttcctgctagttggtgaaactggttggtagacgcgatctgttcgctactaccggcctcccctggctgttaaaagcagatggtggctgaggtttgttcaatgcccgctgcctctgctgtgaagaagccatttgatctcagaagcaagatgggcaagtggtgccaccaccgcttcccctgctgcagggggagcggcaagagcaacatgggcacttctggagaccacgacgactcctttatgaagacgctcaggagcaagatgggcaagtgttgccatcactgcttcccctgctgcagggggagcggcacgagcaatgtgggcacttctggagaccatgacaactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacaggaagtggtgaaatttttaatcaagaaaaaagctaatttaaatgcacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaagagcagaaaacctgaaaatcagcaatttcctgacactgagaatgaagagtatcacagtgacgaacaaaatgatacccagaaacaactttctgaagaacagaacactggaatatcacaagatgagattctgactaataaacaaaagcagatagaagtggctgaaaaggaaatgaattctgagctttctcttagtcataagaaagaagaagatctcttgcgtgaaaacagcatgttgcgggaagaaattgccatgctaagactggaactagatgaaacaaaacatcagaaccagctaagggaaaataaaattttggaggaaattgaaagtgtaaaagaaaaacttctaaaggctatacaactgaatgaagaagcattaacgaaaaccagtatttaagtacagtggacagcttaggattttgacaactgagaatgctcagttctgaactggagaatgtaagacacagctaggaaacactggaaatggaaattcaatcatgtcattgtagactgactactgctctacatgattgtgatcaaagtcagatagctgaaagggacttctttccagagagcaaacatcaacaggtttatttacaggagaaaatgaattcttatatatctcacctaaaagataacagtgagattctttctgaacaactctaacgctgacagtaaaattaacaacctaaaaattaagctccatcacacaggataaattctgagagaaaagatgaggcaggccaccatctttcctgtttgggcaacttagtcattccagcgtgcgggctttggagagtacaaactcaccagggacagaagagatcctgtggcatagcacagctgctttaccaaatcatggccagaatgcttctgtaagcaggcccctgatcctgttcctcatcactggacaggatctcccacctgaggcctccagctacacccaccagtgttccctggccaatggagatttgaaaccttcctgggacagagttcccagagagaggggtgggccatgatgggcaggtcttcctggcctgggtctccagccagccccccacttgagccttcaagccagtagcaactcagcaactccctggacagagcttccaggagcaacagaaatcctctctgcca

SEQ ID NO: 168375 - DNA, 1338 bp, Homo sapiens
  Payload ID: 13138
  Gene Symbol: POTEB3
  Gene Name: POTE ankyrin domain family, member B3
  ENST ID: ENST00000631051
  CDS Start-End: 1-799
ggggagcggcacgagcaatgtgggcacttctggagaccatgacaactcctttatgaagacactcaggagcaagatgggcaagtggtgctgtcactgcttcccctgctgcagggggagcggcaagagcaacgtgggcacttggggagactacgacgacagcgccttcatggagccgaggtaccacgtccgtcgagaagatctggacaagctccacagagctgcctggtggggtaaagtccccagaaaggatctcatcgtcatgctcagggacactgacatgaacaagagggacaagcaaaagaggactgctctacatttggcctctgccaatggaaattcagaagtagtacaactcctgctggacagacgatgtcaacttaacgtccttgacaacaaaaaaaggacagctctgataaaggccgtacaatgccaggaagatgaatgtgtgttaatgttgctggaacatggcgctgatggaaatattcaagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacaggaagtggtgaaatttttaatcaagaaaaaagctaatttaaatgcacttgatagatatggaagaatttgtgaattactttctgactataaagaaaaacagatgctaaaaatctcttctgaaaacagcaatccagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaagagcagaaaacctgaaaatcagcaatttcctgacactgagaatgaagagtatcacagtgacgaacaaaatgatacccagaaacaactttctgaagaacagaacactggaatatcacaagatgagattctgactaataaacaaaagcagatagaagtggctgaaaaggaaatgaattctgagctttctcttagtcataagaaagaagaagatctcttgcgtgaaaacagcatgttgcgggaagaaattgccatgctaagactggaactagatgaaacaaaacatcagaaccagctaagggaaaataaaattttggaggaaattgaaagtgtaaaagaaaaacttctaaaggctatacaactgaatgaagaagcattaacgaaaaccagtatttaagtacagtggacagcttagg

SEQ ID NO: 168376 - DNA, 1629 bp, Homo sapiens
  Payload ID: 13139
  Gene Symbol: POTEC
  Gene Name: POTE ankyrin domain family, member C
  Uniprot ID: B2RU33
  ENST ID: ENST00000358970
  CDS Start-End: 1-1629
atggtgactgaggtttgttcaatgcccgctgcctctgctgtgaagaagccattcgatctcaggagcaagatgggcaagtggtttcaccaccgcttcccctgctgcaaggggagcggcaagagcaacatgggcacttctggagaccacgacgactcctttatgaagatgctcaggagcaagatgggcaagtgttgccaccactgcttcccctgctgcagggggagcggcacgagcaacgtgggcacttctggagaccatgacaactcctttatgaagacgctcaggagcaagatgggcaagtggtgctgtcactgcttcccctgctgcagggggagcggcaagagcaacgtgggcgcttggggagactacgacgacagcgccttcatggagccgaggtaccacgtccgtcgagaagatctggacaagctccacagagctgcctggtggggtaaggtccccagaaaggatctcatcgtcatgctcagggacacggacatgaacaagagggacaagcaaaagaggactgctctacatttggcctctgccaatggaaattcagaagtagtacaactcctgctggacagacgatgtcaacttaatgtccttgacaacaaaaaaaggacagctctgataaaggccgtacaatgccaggaagatgaatgtgtgttaatgttgctggaacatggcgctgatcaaaatattccagatgagtatggaaataccactctacactatgctgtccacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgcacttgatagatatggaagaactgccctcatacttgctgtatgttgtggatcagcaagtatagtcaatcttctccttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctaacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaggagcagaaaacctgaaaatcagcaatttcctgacactgagaatgaagagtatcacagtgacgaacaaaatgatacccggaaacaactttctgaagaacagaacactggaatatcacaagatgagattctgactaataaacaaaagcagatagaagtggctgaaaagaaaatgaattctgagctttctcttagtcataagaaagaagaagatctcttgcgtgaaaacagcatgttgcaggaagaaattgccatgctaatttctggagactggaactag

SEQ ID NO: 168377 - DNA, 6556 bp, Homo sapiens
  Payload ID: 13139
  Gene Symbol: POTEC
  Gene Name: POTE ankyrin domain family, member C
  ENST ID: ENST00000511306
  CDS Start-End: 440-1594
acctgtaacgggtacgcttcgctttgcgttcctcgcttggccttgcgttcctagcttggcttggcgttagtcgctttgcctggtgtttcttgcttggattggcgtttcctccctcgcattcctttgctgggcttgactttttctctgctgggtttggcattcccttgactgggctgggtgtttccttgggagggggggcttggcctttcctggggtgggcgttgggtccccctggtgggcgtgggctttccccgggtgggtgtgggttttccctgggtggggtggactgggctcccttgctggggttggcaagttttggctgggattgacctttctcttcaaacagattggaaacccagggtttcctgctagttggtgaaactggttggtagacgcgatctgttcgctactaccggcctccccgggctgttaaaagcagatggtgactgaggtttgttcaatgcccgctgcctctgctgtgaagaagccattcgatctcaggagcaagatgggcaagtggtttcaccaccgcttcccctgctgcaaggggagcggcaagagcaacatgggcacttctggagaccacgacgactcctttatgaagatgctcaggagcaagatgggcaagtgttgccaccactgcttcccctgctgcagggggagcggcacgagcaacgtgggcacttctggagaccatgacaactcctttatgaagacgctcaggagcaagatgggcaagtggtgctgtcactgcttcccctgctgcagggggagcggcaagagcaacgtgggcgcttggggagactacgacgacagcgccttcatggagccgaggtaccacgtccgtcgagaagatctggacaagctccacagagctgcctggtggggtaaggtccccagaaaggatctcatcgtcatgctcagggacacggacatgaacaagagggacaagcaaaagaggactgctctacatttggcctctgccaatggaaattcagaagtagtacaactcctgctggacagacgatgtcaacttaatgtccttgacaacaaaaaaaggacagctctgataaaggccgtacaatgccaggaagatgaatgtgtgttaatgttgctggaacatggcgctgatcaaaatattccagatgagtatggaaataccactctacactatgctgtccacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgcacttgatagatatggaagaactgccctcatacttgctgtatgttgtggatcagcaagtatagtcaatcttctccttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaggagcagaaaacctgaaaatcagcaatttcctgacactgagaatgaagagtatcacagtgacgaacaaaatgatacccggaaacaactttctgaagaacagaacactggaatatcacaagatgagattctgactaataaacaaaagcagatagaagtggctgaaaagaaaatgaattctgagctttctcttagtcataagaaagaagaagatctcttgcgtgaaaacagcatgttgcaggaagaaattgccatgctaatttctggagactggaactagatgaaacaaaacatcagaaccagctaagggaaaataaaattttggaggaaattgaaagtgtgaaagaaaagactgataaacttctaagggctatgcaattgaatgaagaagcattaacgaaaaccaatatttaagtacagtggacagcttaggattttgacaactgagaatgctcagttctgaactggagaatgtaagacacagctaggaaacactggaaatggaaattcaatcatgtcattgtagactgactactgctctacatgattgtgatcaaagtcagatagctgaaagggacttctttccagagaacaaacatgaacaggtttatttacaggagaaaatgaattctcatatatctcacctaaaagataacagtgagattctttctgaacaactctaacgctgacagtaaaattaacaacctaaaaattaagctccatcacacaggataaattctgagagaaaagatgaggcaggccaccatctttcctgtttgggcaacttagcgattccagcgtgcgggctttggagagtacaaacccaccaggggcagaagagatcctgtggcatagcacagctgctttaccaaatcatgtccagaatgcttctgtaagcaggcctctgatcctgttcctcgtcactggacaggatctcccacctgaggcctccagctacacccaccagtgttccctggccaatggagatttgaaaccttcctgggacagagttcccagagagaggggtgggccatgacctttgttgtttgggcaactagcccttctggcctgtgggctttggagagcccaagctgaccaggggtggaagtggtacctcagcacagaacagccaccctgcgaaaacgtggccagattcttgtttaagccagtccccaaccacatttctaatcactgggtggagcctttcaaccagggtctccagccaccttcactgctgttctctggctcacagaggtttcaggcctcctgagtcagagctcccagggggaggaccagactgtcatctttgctgtttggatgactcagccagttcagtcttagagtttcagagtgtctgaggagaccaggggctgaagtgaaccccccacacagcatagccactctacaaaaacgtggccagacttcttttttaaacaagtccctattcctgttcctccttactaggcaagacttctcaacttgcttccagtcacatcctacaggtgtgttgagattggcaacaggttcatacctcagaggtacagagctcccagagggaagggcaggctatcgtctttgctttttctcaggcttcactgctgataccttcagccactggaaaatacgaggcaattggcgactggagtggacccccagcataccacggcagccccacagaaaagtggccagactgttatgtgggtgcccatttccatatctcctcgatgggcaggtcttcctggcctgggtctccagccagccccccacttgagctttcaagccagtagcaactcagcaactccctggacagagcttccaggagcaacagaaatcctctctgccactgcctctgcagtggaactgcccttgctaccctcagaatatcaagggagcaaagaccctaagtgccatattgacacctccaacaagctgcagttgacacaaggaacaagtcagtccatcttccacaggtacaacacaccccttactgctcatcaccagacaaggaaccgtggcttgggcccacaacacagaccctccatcctggggtgattacattaagtaactgctaacttacacctctctggggtggagcccccaggagacaaggaaagtagtggagcagcaagtcagctgatgtggagcctggagggcagggacagctatgtctctaggctccacttgctcttatgagacactttatcccagcactttaggagtgctgaggtcagaccagccccatctcacgtgcaagattgcccagcacagatcaggtctaagagttctcttcgtaaaaaaggggacttgcttaaaaaagaagtctggccacgtttgtgtagagcagttgtgctgtgctgaggattcacttttgagagagttctcctctgagacctgatctgtgctgggcagtcttgcacatgagatggggctggtctgacctcagcaccccttagtctgcttgcctctcccaggaccccagccaggccacacctgcttagagggcactttcgggtgcccacaccatagcttctgtacaagcggaccgtgcctgatcagtggagagctgcagcaaggtgacctctacagccacgcactagcctgcacattaccattccatactgcagccctttatatggaaacttcctacatcactttgctgtgtgtgtttacacaggtgggttttgttgtacttgccctaacagcatatgggaatgcagcacacaccccaacccacaccaactgccactgaagatgaagccatggtgggcacagaaccaaaaaccccacccctgctagcatctcacccttgaggtaatgctgtgcagaggaaaagggaccttcttataccctgagtgaccactgttgcttgggggggatcagagaaggcaccttcactggccagccacccaccccaaaccagcactacctccagtgcaacagcacacacagtcagcaggggcccgtggcccacaccccagctgttttgcctccaccactgggtgaatgcccacagggaggcagggacttttgcatctgctagcattctgccacagctgctgcactttggtcccctcagtgcagtggactccaaacctcgaggagccagaggacaaagttgtggcccaatacaagttccccagagttaaagcacacagtccaagaattgggagctgcatgttggccccttaaaatcctccaaaaacaaaacctgttggctgaatccaccttacaccacaatcaaatcctcaaggtcatcagatataataaaggaaaaataccctgtccaaaggtcagcaacctcaaagattgaagatggataagcccataaagatgagaaaaagactctgtgcaagaacactgaaaactcaaaaattcagcataccttcttttctccaaatgactgcatcaactctccagcaagtgttcagaactgggctgaggctgagatgtctgaaatgatacaagcagagttcaggatatgggtaggaacaaagttcattgagtgaaagaagtatgttgtaatccaatacaaggaagctaaaaatcattgtaaaacattgcaggaactaacagacaaaatagtgagtataaagaagaaaataactgacctgacagagctgtaaatcacactagaagaattttcataatgtagtcacatggtgattgtgtgtgattgcattatgaatattattgtagtatgtgtgggcacctgagagtgccctgtaagcaggtgtggccaggctggggtcctgggagaggcaagcagactagggagggctgaggtcagaccagctccatctcatgtgcaagaccatctaacagaatagaccaagaagaggaaagaatcccagagcttgaaaactggctttctgaaataaaacaggcaaacaagaatgggggaaaaaagaatgaaagggaatgaacaaaacatccgagaaatatgggattatataaacgaccaaatctatgactgattaatgtacctgaaagagatgaggagaatggaaccaacttggaaaacacatttcagaatatcattcatgagaatgtccccaacctagccagacaggccaacattcaacttcaggaaatccagagaacctcagtaagatatgccatgagaagatcatccccaagacacataatcatcagattctctgaggtcaaaataaaagaaaaaatgttaaaggcagctagggagaaaggcaacatcacctgcaaagggaattccatcagacttagcagacctctcaactgaaactgtacaagccagaaaagacattcaacatttcaaagaaaagaaatttcaacccagaatttcatgtccagcaaaattaagcatcataagtgaaggagaaacaagatcgttttcagacaagcaaatgctgagggaattcgttatcaccagacctaccttacaagagctcctgaaggaagcactaaatatggaaagaaaagaccaccaccagccactacaaaaacacactgaagtacacagacaagtgatgctaaaaaccaaccacatacataagtctgcaaaagagccagctgacagcatgatgacaggatcaaatccacacataccattactaaccttaaatggaaatgggctaaatgctccaattgaaagacacagggggcaagctggataaagaaccaagacccattggagtatgccgtcttcaagaaacccatctcacatgcagtgccatacataggctcaaaataaaggaatggagaaaaatatttcaaggaaatggaaaacagaaaaaagcaggtgttgcactcctagtttctgacaaaacagactataccaataaagatttaaaaaaaaaaaaa

SEQ ID NO: 168378 - DNA, 2147 bp, Homo sapiens
  Payload ID: 13139
  Gene Symbol: POTEC
  Gene Name: POTE ankyrin domain family, member C
  ENST ID: ENST00000618124
  CDS Start-End: 368-2128
gctttgcctggtgtttcttgcttggattggcgtttcctccctcgcattcctttgctgggcttgactttttctctgctgggtttggcattcccttgactgggctgggtgtttccttgggagggggggcttggcctttcctggggtgggcgttgggtccccctggtgggcgtgggctttccccgggtgggtgtgggttttccctgggtggggtggactgggctcccttgctggggttggcaagttttggctgggattgacctttctcttcaaacagattggaaacccagggtttcctgctagttggtgaaactggttggtagacgcgatctgttcgctactaccggcctccccgggctgttaaaagcagatggtgactgaggtttgttcaatgcccgctgcctctgctgtgaagaagccattcgatctcaggagcaagatgggcaagtggtttcaccaccgcttcccctgctgcaaggggagcggcaagagcaacatgggcacttctggagaccacgacgactcctttatgaagatgctcaggagcaagatgggcaagtgttgccaccactgcttcccctgctgcagggggagcggcacgagcaacgtgggcacttctggagaccatgacaactcctttatgaagacgctcaggagcaagatgggcaagtggtgctgtcactgcttcccctgctgcagggggagcggcaagagcaacgtgggcgcttggggagactacgacgacagcgccttcatggagccgaggtaccacgtccgtcgagaagatctggacaagctccacagagctgcctggtggggtaaggtccccagaaaggatctcatcgtcatgctcagggacacggacatgaacaagagggacaagcaaaagaggactgctctacatttggcctctgccaatggaaattcagaagtagtacaactcctgctggacagacgatgtcaacttaatgtccttgacaacaaaaaaaggacagctctgataaaggccgtacaatgccaggaagatgaatgtgtgttaatgttgctggaacatggcgctgatcaaaatattccagatgagtatggaaataccactctacactatgctgtccacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgcacttgatagatatggaagaactgccctcatacttgctgtatgttgtggatcagcaagtatagtcaatcttctccttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctaacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaggagcagaaaacctgaaaatcagcaatttcctgacactgagaatgaagagtatcacagtgacgaacaaaatgatacccggaaacaactttctgaagaacagaacactggaatatcacaagatgagattctgactaataaacaaaagcagatagaagtggctgaaaagaaaatgaattctgagctttctcttagtcataagaaagaagaagatctcttgcgtgaaaacagcatgttgcaggaagaaattgccatgctaattctggagctggaactagatgaaacaaaacatcagaaccagctaagggaaaataaaattttggaggaaattgaaagtgtgaaagaaaagactgataaacttctaagggctatgcaattgaatgaagaagcattaacgaaaaccaatatttaagtacagtggacagcttagg

SEQ ID NO: 168379 - DNA, 1988 bp, Homo sapiens
  Payload ID: 13139
  Gene Symbol: POTEC
  Gene Name: POTE ankyrin domain family, member C
  ENST ID: ENST00000620346
  CDS Start-End: 372-1517
agtcgctttgcctggtgtttcttgcttggattggcgtttcctccctcgcattcctttgctgggcttgactttttctctgctgggtttggcattcccttgactgggctgggtgtttccttgggagggggggcttggcctttcctggggtgggcgttgggtccccctggtgggcgtgggctttccccgggtgggtgtgggttttccctgggtggggtggactgggctcccttgctggggttggcaagttttggctgggattgacctttctcttcaaacagattggaaacccagggtttcctgctagttggtgaaactggttggtagacgcgatctgttcgctactaccggcctccccgggctgttaaaagcagatggtgactgaggtttgttcaatgcccgctgcctctgctgtgaagaagccattcgatctcaggagcaagatgggcaagtggtttcaccaccgcttcccctgctgcaaggggagcggcaagagcaacatgggcacttctggagaccacgacgactcctttatgaagatgctcaggagcaagatgggcaagtgttgccaccactgcttcccctgctgcagggggagcggcacgagcaacgtgggcacttctggagaccatgacaactcctttatgaagacgctcaggagcaagatgggcaagtggtgctgtcactgcttcccctgctgcagggggagcggcaagagcaacgtgggcgcttggggagactacgacgacagcgccttcatggagccgaggtaccacgtccgtcgagaagatctggacaagctccacagagctgcctggtggggtaaggtccccagaaaggatctcatcgtcatgctcagggacacggacatgaacaagagggacaagcaaaagaggactgctctacatttggcctctgccaatggaaattcagaagtagtacaactcctgctggacagacgatgtcaacttaatgtccttgacaacaaaaaaaggacagctctgataaaggccgtacaatgccaggaagatgaatgtgtgttaatgttgctggaacatggcgctgatcaaaatattccagatgagtatggaaataccactctacactatgctgtccacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgcacttgatagatatggaagaactgccctcatacttgctgtatgttgtggatcagcaagtatagtcaatcttctccttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccaggtaaagaagcagaagaataatgtttggcagaaggaacatgcaacaagattgtgtgtttgccagaagaacatctaatgaggttgcctgtttggcaggaagagcagcaagtgcaaaacgcaagatgctgagtgaaccttgcagggtttctgagcagttcacttttgctagtaccaaaagtgtgagacaccagaggttgggaataaggtgaatacttagctaagtgtgaaagccaccatgattatatgtaagcaaacaggcatgactgagctcctataaaactttatttacaaagccaaaaggcagactggatttggcctgtggcctatagcttgctgggattgagggaagataaccatgtaaagaaaccaggagacaaaggaagcttttgcagtagtcagctatagtttccatgtcacacacccttggactagtatcaatgtattctaaggttttcacctgcccatggcaaaataaagtttggaatctcagtt

SEQ ID NO: 168380 - DNA, 1826 bp, Homo sapiens
  Payload ID: 13140
  Gene Symbol: POTED
  Gene Name: POTE ankyrin domain family, member D
  Uniprot ID: Q86YR6
  ENST ID: ENST00000299443
  CDS Start-End: 53-1807
ggtagacgcgatctgttcgctactaccggcctcccctggctgttaaaagcagatggtggctgaggtttgttcaatgcccactgcctctactgtgaagaagccatttgatctcaggagcaagatgggcaagtggtgccaccaccgcttcccctgctgcagggggagcggcaagagcaacatgggcacttctggagaccacgacgactcctttatgaagatgctcaggagcaagatgggcaagtgttgccgccactgcttcccctgctgcagggggagcggcacgagcaacgtgggcacttctggagaccatgaaaactcctttatgaagatgctcaggagcaagatgggcaagtggtgctgtcactgcttcccctgctgcagggggagcggcaagagcaacgtgggcgcttggggagactacgaccacagcgccttcatggagccgaggtaccacatccgtcgagaagatctggacaagctccacagagctgcctggtggggtaaagtccccagaaaggatctcatcgtcatgctcagggacactgacatgaacaagagggacaaggaaaagaggactgctctacatttggcctctgccaatggaaattcagaagtagtacaactcctgctggacagacgatgtcaacttaatgtccttgacaacaaaaaaaggacagctctgataaaggccatacaatgccaggaagatgaatgtgtgttaatgttgctggaacatggcgctgatcgaaatattccagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgtacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctgacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaggagcagaaaacctgaaaatcagcaatttcctgacactgagaatgaagagtatcacagtgatgaacaaaatgatacccggaaacaactttctgaagaacagaacactggaatatcacaagatgagattctgactaataaacaaaagcagatagaagtggctgaacagaaaatgaattctgagctttctcttagtcataagaaagaagaagatctcttgcgtgaaaacagcgtgttgcaggaagaaattgccatgctaagactggaactagatgaaacaaaacatcagaaccagctaagggaaaataaaattttggaggaaattgaaagtgtgaaagaaaagactgataaacttctaagggctatgcaattgaatgaagaagcattaacgaaaaccaatatttaagtacagtggacagcttagg

SEQ ID NO: 168381 - DNA, 1988 bp, Homo sapiens
  Payload ID: 13140
  Gene Symbol: POTED
  Gene Name: POTE ankyrin domain family, member D
  ENST ID: ENST00000620442
  CDS Start-End: 372-1517
agtcgctttgcctggtgtttcttgcttggattggcgttttctccctcgcattcctttgctgggcctgaatttttctctgctgggtttggcattcccttgactgggctgggtgtttccttcggagggggggcttggcctttcctggggtgggcctggggtccccctggtgggcgtgggctttccccgggtgggtgtgggttttccctgggtggggtgggctgggctcccttgctggggttggcaagttttggctgggattgacctttctcttcaaacagattggaaacccaaggtttcctgctagttggtgaaactggttggtagacgcgatctgttcgctactaccggcctcccctggctgttaaaagcagatggtggctgaggtttgttcaatgcccactgcctctactgtgaagaagccatttgatctcaggagcaagatgggcaagtggtgccaccaccgcttcccctgctgcagggggagcggcaagagcaacatgggcacttctggagaccacgacgactcctttatgaagatgctcaggagcaagatgggcaagtgttgccgccactgcttcccctgctgcagggggagcggcacgagcaacgtgggcacttctggagaccatgaaaactcctttatgaagatgctcaggagcaagatgggcaagtggtgctgtcactgcttcccctgctgcagggggagcggcaagagcaacgtgggcgcttggggagactacgaccacagcgccttcatggagccgaggtaccacatccgtcgagaagatctggacaagctccacagagctgcctggtggggtaaagtccccagaaaggatctcatcgtcatgctcagggacactgacatgaacaagagggacaaggaaaagaggactgctctacatttggcctctgccaatggaaattcagaagtagtacaactcctgctggacagacgatgtcaacttaatgtccttgacaacaaaaaaaggacagctctgataaaggccatacaatgccaggaagatgaatgtgtgttaatgttgctggaacatggcgctgatcgaaatattccagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgtacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccaggtaaagaagcagaagaataatgtttggcagaaggaacacgcaacaagattgtgtgtttgccagaagaacatctaatgagattgcctgtttggcaggaagagcagcaagtgcaaaacacaagatgctgagtgaactttgcagggtttctgagcagttcacttttgctagtaccaaaagtgtgagacaccagaggttgggaataaggtgaatacttagctaagtgtgaaagccaccatgattatatgtaagcaaacaggcatgactgagctcctataaaactttatttacaaagccaaaaggcagattggatttggcctgtggcctatagtttgctgggattgatggaagataaccatgtaaagaaaccaggagaaaaaggaagcttttgcagtagtcagctatagtttccatgtcacacatccttggactagtatcaatgtattctaaggttttcacctgcccatggcaaaataaagtttggaatctcagtt

SEQ ID NO: 168382 - DNA, 4159 bp, Homo sapiens
  Payload ID: 13141
  Gene Symbol: POTEE
  Gene Name: POTE ankyrin domain family, member E
  Uniprot ID: Q6S8J3
  ENST ID: ENST00000356920
  CDS Start-End: 337-3564
tgctgggcttgaccttttctctgctgggtttggcattcccttgggtgggctgggtgttttcttgggggcgggggttggccctttctggggttggccctttctggggtgggcgtggggtcgcccagggggggcgtgggctttcctcgggtgggtgtgggttttccctgggtggggtgggctgggctggaatcccctgctggggttggcaggttttggctgggattgacatttctcttcaaacagattggaaacccggagttacctgctagttggtgaaactggttggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctacagggagagcggcaagagcaacgtgggcacttctggagaccacgacgactctgctatgaagacactcaggagcaagatgggcaagtggtgccaccactgcttcccctgctgcagggggagtggcaagagcaacgtgggcgcttctggagaccacgacgactctgctatgaagacactcaggaacaagatggggaagtggtgctgccactgcttcccctgctgcagggggagcggcaagagcaaggtgggcgcttggggagactacgatgacagcgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagagttaaagctgacatcagaggaagagtcacaaaggttcaaaggcagtgaaaatagccagccagagaaaatgtctcaagaactagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacgtcttgcatgaaaatagtacgttgcgggaagaaattgccatgctaagactggagctagacacaatgaaacatcagagccagctaagagaaaagaaatatttggaggatattgaaagtgtgaaaaaaaagaatgataatcttttaaaggctctacaattgaatgagctcaccatggatgatgataccgccgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaagagaggcatcctgaccctgaagtaccccatggaacacggcatcatcaccaactgggatgacatggagaagatctggcaccacaccttctacaacgagctgcgtgtggctcccgaggagcaccccatcctgctgaccgaggcccccctgaaccccaaggccaaccgcgagaagatgacccagatcatgtttgagaccttcaacaccccagccatgtacgtggccatccaggccgtgccgtccctgtacacctctggccgtactactggcatcgtgatggactctggtgacggggtcacccacactgtgcccatctatgaggggaatgccctcccccatgccaccctgcgcctagacctggctgggcgggaactgcctgactacctcatgaagatcctcaccgagcgtggctataggttcaccaccatggccgagcgggaaatcgtgcgtgacatcaaagagaagctgtgctatgttgccctggacttcgagcaggagatggccacggcggcctccagctcctccctagagaagagctacgagctgcccgatggccaggtcatcaccatcggcaacgagcggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgatgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgttgccaaggactttgattgtacattgttcttcttttcaatagtcattccaaatattgtgagacgcattgtttcaggaagccccttgccctgctaaaagccatcccacttctctctaaggagaatggcccagtcctctccctagttcacacaggggaggtgatagcattgcttttgtgcaaattacataatgcaaaattttttgaatcttcgccttaatactttttaattttgttttattttgaatgatcagccttcgtggcccccctcttttgtaccccaacttggggtgtatgaaggcttttggtctccctgagagtggctggaggcagccagggcttacctgtactctgacttgaggagagttggataaaagtgcacaccttaaaaaaaa

SEQ ID NO: 168383 - DNA, 2147 bp, Homo sapiens
  Payload ID: 13141
  Gene Symbol: POTEE
  Gene Name: POTE ankyrin domain family, member E
  Uniprot ID: Q6S8J3
  ENST ID: ENST00000358087
  CDS Start-End: 53-1237
ggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctacagggagagcggcaagagcaacgtgggcacttctggagaccacgacgactctgctatgaagacactcaggagcaagatgggcaagtggtgccaccactgcttcccctgctgcagggggagtggcaagagcaacgtgggcgcttctggagaccacgacgactctgctatgaagacactcaggaacaagatggggaagtggtgctgccactgcttcccctgctgcagggggagcggcaagagcaaggtgggcgcttggggagactacgatgacagcgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggtatgcagtagccaactatatcagcatgaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaaaatgtctcaagaactagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacgtcttgcatgaaaatagtacgttgcgggaagaaattgccatgctaagactggagctagacacaatgaaacatcagagccagctaagagaaaagaaatatttggaggatattgaaagtgtgaaaaaaaagaatgataatcttttaaaggctctacaattgaatgagctcaccatggatgatgataccgccgtgctcgtcattgacaac

SEQ ID NO: 168384 - DNA, 2072 bp, Homo sapiens
  Payload ID: 13141
  Gene Symbol: POTEE
  Gene Name: POTE ankyrin domain family, member E
  Uniprot ID: Q6S8J3
  ENST ID: ENST00000514256
  CDS Start-End: 53-1183
ggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctacagggagagcggcaagagcaacgtgggcacttctggagaccacgacgactctgctatgaagacactcaggagcaagatgggcaagtggtgccaccactgcttcccctgctgcagggggagtggcaagagcaacgtgggcgcttctggagaccacgacgactctgctatgaagacactcaggaacaagatggggaagtggtgctgccactgcttcccctgctgcagggggagcggcaagagcaaggtgggcgcttggggagactacgatgacagcgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacgtcttgcatgaaaatagtacgttgcgggaagaaattgccatgctaagactggagctagacacaatgaaacatcagagccagctaagagaaaagaaatatttggaggatattgaaagtgtgaaaaaaaagaatgataatcttttaaaggctctacaattgaatgagctcaccatggatgatgataccgccgtgctcgtcattgacaac

SEQ ID NO: 168385 - DNA, 1926 bp, Homo sapiens
  Payload ID: 13141
  Gene Symbol: POTEE
  Gene Name: POTE ankyrin domain family, member E
  ENST ID: ENST00000613282
  CDS Start-End: 53-1579
ggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctacagggagagcggcaagagcaacgtgggcacttctggagaccacgacgactctgctatgaagacactcaggagcaagatgggcaagtggtgccaccactgcttcccctgctgcagggggagtggcaagagcaacgtgggcgcttctggagaccacgacgactctgctatgaagacactcaggaacaagatggggaagtggtgctgccactgcttcccctgctgcagggggagcggcaagagcaaggtgggcgcttggggagactacgatgacagcgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagagttaaagctgacatcagaggaagagtcacaaaggttcaaaggcagtgaaaatagccagccagagaaaatgtctcaagaactagaaataaataaggatggtgatagaaaggttgaagaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaatgaattctgagctttctcttagttgtaagaaagaaaaagacgtcttgcatgaaaatagtacgttgcgggaagaaattgccatgctaagactggagctagacacaatgaaacatcagagccagctaagagaaaagaaatatttggaggatattgaaagtgtgaaaaaaaagaatgataatcttttaaaggctctacaattgaatgagctcaccatggatgatgataccgccgtgctcgtcattgacaacggctctggcatgtgcaaggccggctttgcgggcgacgatgccccccgggctgtcttcccttccatcgtggggcgccccaggcagcagggcatgatggggggcatgcatc

SEQ ID NO: 168386 - DNA, 2027 bp, Homo sapiens
  Payload ID: 13141
  Gene Symbol: POTEE
  Gene Name: POTE ankyrin domain family, member E
  Uniprot ID: Q6S8J3
  ENST ID: ENST00000626191
  CDS Start-End: 53-1183
ggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctacagggagagcggcaagagcaacgtgggcacttctggagaccacgacgactctgctatgaagacactcaggagcaagatgggcaagtggtgccaccactgcttcccctgctgcagggggagtggcaagagcaacgtgggcgcttctggagaccacgacgactctgctatgaagacactcaggaacaagatggggaagtggtgctgccactgcttcccctgctgcagggggagcggcaagagcaaggtgggcgcttggggagactacgatgacagcgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagctagaaaattttatggctatcgaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacgtcttgcatgaaaatagtacgttgcgggaagaaattgccatgctaagactggagctagacacaatgaaacatcagagccagctaagagaaaagaaatatttggaggatattgaaagtgtgaaaaaaaagaatgataatcttttaaaggctctacaattgaatgagctcaccatggatgatgataccgccgtgctcgtcattgacaac

SEQ ID NO: 168387 - DNA, 4031 bp, Homo sapiens
  Payload ID: 13142
  Gene Symbol: POTEF
  Gene Name: POTE ankyrin domain family, member F
  Uniprot ID: A5A3E0
  ENST ID: ENST00000357462
  CDS Start-End: 95-3322
gattggaaacccggagttacctgctagttggtgaaactggttggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcagcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagcaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaattaagaaaaaagcgaatttaaatgcactggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacagaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacatcttgcatgaaaatagtacgttgcgggaagaaattgccatgctaagactggagctagacacaatgaaacatcagagccagctaagagaaaagaaatatttggaggatattgaaagtgtgaaaaaaaggaatgataatcttttaaaggctctacaattgaatgagctcaccatggatgatgataccgctgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaaaagaggcatcctgaccctgaagtaccccatggaacacggcatcatcaccaactgggatgacatggagaagatctggcaccacaccttctacaacgagctgcgtgtggctcccgaggagcaccccgtcctgctgaccgaggccaccctgaaccctaaggccaaccgcgagaagatgacccagatcatgtttgagaccttcaacaccccagccatgtacgtggccatccaggctgtgctgtccctgtacacctctggccgtactactggcatcgtgatggactctggtgacggggtcacccacactgtgcccatctatgaggggaatgccctcccccatgccaccctgcgcctagacctggctgggcgggaactgcctgactacctcatgaagatcctcaccgagcatggctataggttcaccaccatggccgagcgggaaatcgtgcgtgacatcaaagagaagctgtgctatgttgccctggacttcgagcaggagatggccacggtggcctccagctcctccctagagaagagctacgagctgcccgatggccaggtcatcaccatcggcaacgagcggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgatgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttgtaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgtggccaaggactttgattgtaccttgttcttcttttcaatagtcattccaaatattgtgagacgcattgtttcaggaagccccttgccctgctaaaagccaccccacttctctctaaggagaatggcccagtcctctccctagttcacacaggggaggtgatagcattgcttttgtgcaaattacataatgcaaaattttttgaatcttcgccttaatactttttaattttgttttattttgaatgatcagccttcgtggcccccctcttttgtaccccaacttggggtgtatgaaggcttttggtctccctgagagtggctggaggcagccagggcttacctgtactctgacttgaggagagttggataaaagtgcacaccttaaaacaaattgaggaagcacagtatttcagtacagtggacagcttagcatgttgacaactgagaataaaatgctcagttctgaactggacaatgtaagacacaacgaggaaacactggaaat

SEQ ID NO: 168388 - DNA, 1926 bp, Homo sapiens
  Payload ID: 13142
  Gene Symbol: POTEF
  Gene Name: POTE ankyrin domain family, member F
  ENST ID: ENST00000361163
  CDS Start-End: 53-1579
ggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcagcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagcaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaattaagaaaaaagcgaatttaaatgcactggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagaaaggttgaagaagaaatgaagaagcacagaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaatgaattctgagctttctcttagttgtaagaaagaaaaagacatcttgcatgaaaatagtacgttgcgggaagaaattgccatgctaagactggagctagacacaatgaaacatcagagccagctaagagaaaagaaatatttggaggatattgaaagtgtgaaaaaaaggaatgataatcttttaaaggctctacaattgaatgagctcaccatggatgatgataccgctgtgctcgtcattgacaacggctctggcatgtgcaaggccggctttgcgggcgacgatgccccccgggctgtcttcccttccatcgtggggcgccccaggcagcagggcatgatggggggcatgcatc

SEQ ID NO: 168389 - DNA, 3842 bp, Homo sapiens
  Payload ID: 13142
  Gene Symbol: POTEF
  Gene Name: POTE ankyrin domain family, member F
  Uniprot ID: A5A3E0
  ENST ID: ENST00000409914
  CDS Start-End: 401-3628
gcgggagcttctcctgccaggcaggaagacgagtagaagggagcggcatgctggaggctggagcctgagcccctggggctcgccttgctgtgtttggtggtgacgtgggacactgcagctcggccagagtggtagaaatgtcctggtgtaggcttttctggctttgcccgtctagctgctccaagccaggctggaggaggaggagaaggaatcacctgtggtacgctggagcctgcatgtggcgtgactctgcagctcgcctcgtgtgactgatggcagccacggagactgcagctcgacaggagtgattggaaacccggagttacctgctagttggtgaaactggttggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcagcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagcaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaattaagaaaaaagcgaatttaaatgcactggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacagaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacatcttgcatgaaaatagtacgttgcgggaagaaattgccatgctaagactggagctagacacaatgaaacatcagagccagctaagagaaaagaaatatttggaggatattgaaagtgtgaaaaaaaggaatgataatcttttaaaggctctacaattgaatgagctcaccatggatgatgataccgctgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaaaagaggcatcctgaccctgaagtaccccatggaacacggcatcatcaccaactgggatgacatggagaagatctggcaccacaccttctacaacgagctgcgtgtggctcccgaggagcaccccgtcctgctgaccgaggccaccctgaaccctaaggccaaccgcgagaagatgacccagatcatgtttgagaccttcaacaccccagccatgtacgtggccatccaggctgtgctgtccctgtacacctctggccgtactactggcatcgtgatggactctggtgacggggtcacccacactgtgcccatctatgaggggaatgccctcccccatgccaccctgcgcctagacctggctgggcgggaactgcctgactacctcatgaagatcctcaccgagcatggctataggttcaccaccatggccgagcgggaaatcgtgcgtgacatcaaagagaagctgtgctatgttgccctggacttcgagcaggagatggccacggtggcctccagctcctccctagagaagagctacgagctgcccgatggccaggtcatcaccatcggcaacgagcggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgatgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttgtaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgtggccaaggac

SEQ ID NO: 168390 - DNA, 2147 bp, Homo sapiens
  Payload ID: 13142
  Gene Symbol: POTEF
  Gene Name: POTE ankyrin domain family, member F
  ENST ID: ENST00000630260
  CDS Start-End: 53-1237
ggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcagcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagcaggacaagcaaaagaggactgctctacatctggcctctgccaatgggaattcagaagtagtaaaactcctgctggacagacgatgtcaacttaatgtccttgacaacaaaaagaggacagctctgataaaggtatgcagtagccaactatatcagcatgaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaattaagaaaaaagcgaatttaaatgcactggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaaaatgtctcaagaaccagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacagaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacatcttgcatgaaaatagtacgttgcgggaagaaattgccatgctaagactggagctagacacaatgaaacatcagagccagctaagagaaaagaaatatttggaggatattgaaagtgtgaaaaaaaggaatgataatcttttaaaggctctacaattgaatgagctcaccatggatgatgataccgctgtgctcgtcattgacaac

SEQ ID NO: 168391 - DNA, 2073 bp, Homo sapiens
  Payload ID: 13143
  Gene Symbol: POTEG
  Gene Name: POTE ankyrin domain family, member G
  Uniprot ID: Q6S5H5
  ENST ID: ENST00000547722
  CDS Start-End: 53-1021
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgacgattctgctatgaagacactcaggagcaagatgggcaagtggtgccgccactgcttcccctggtgcagggggagcagcaagagcaacgtgggcacttctggagaccacgacgactctgctatgaagacactcaggagcaagatgggcaagtggtgctgccactgcttcccctgctgcagggggagcggcaagagcaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccgggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagattgagtctcactctgtttcccaggctggagtgcagtggtgtgatcacagctcactgcaacctcgacctcccgaagctcagatggtcctccaacctcaacctcagttgtttttttctttctttctttttatttttatttttatttttatttttttttagtagagatgaggtttttgccatgtttctcaggctggtcttgaactcctgggctcaagcaattcatccccctcagcctcccaaagtgctaggattacagcatggcctcacaccactgttacttggtgtacatgagcaaaaacagcaagtggtgaaattcttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcatcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacgtaatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaac

SEQ ID NO: 168392 - DNA, 2204 bp, Homo sapiens
  Payload ID: 13143
  Gene Symbol: POTEG
  Gene Name: POTE ankyrin domain family, member G
  Uniprot ID: Q6S5H5
  ENST ID: ENST00000547848
  CDS Start-End: 53-1579
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgacgattctgctatgaagacactcaggagcaagatgggcaagtggtgccgccactgcttcccctggtgcagggggagcagcaagagcaacgtgggcacttctggagaccacgacgactctgctatgaagacactcaggagcaagatgggcaagtggtgctgccactgcttcccctgctgcagggggagcggcaagagcaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccgggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaattcttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcatcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacgtaatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaacggctctggcatgtgcaaggccggctttgcaggtgacgatgccccccgggctgtcttcccttccatcgtggggtgccccaggcaccagaacatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccggatcatgtttgagaccttcaacaccccagccatgtacgtggccatccaagccgtgctgtcc

SEQ ID NO: 168393 - DNA, 1975 bp, Homo sapiens
  Payload ID: 13143
  Gene Symbol: POTEG
  Gene Name: POTE ankyrin domain family, member G
  Uniprot ID: Q6S5H5
  ENST ID: ENST00000622767
  CDS Start-End: 53-1513
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgacgattctgctatgaagacactcaggagcaagatgggcaagtggtgccgccactgcttcccctggtgcagggggagcagcaagagcaacgtgggcacttctggagaccacgacgactctgctatgaagacactcaggagcaagatgggcaagtggtgctgccactgcttcccctgctgcagggggagcggcaagagcaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccgggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaattcttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcatcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagggacttttctggccatcccaactttcccacgacccttcccatcaaacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacgtaatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaacggctctggcatgtgcaaggccggctttgcaggtgacgatgccccccgggctgtcttcccttccatcgtggggtgccccaggcaccagaacatgatggggggcatgcgtc

SEQ ID NO: 168394 - DNA, 1928 bp, Homo sapiens
  Payload ID: 13144
  Gene Symbol: POTEH
  Gene Name: POTE ankyrin domain family, member H
  Uniprot ID: Q6S545
  ENST ID: ENST00000343518
  CDS Start-End: 53-1690
ggtagacgcgatctgctggctactaccggccttccctggctgttaaaagcagatggtggctgaggctggttcaatgccggctgcctcctctgtgaagaagccatttggtctcagaagcaagatgggcaagtggtgccgccactgcttcgcctggtgcagggggagcggcaagagcaacgtgggcacttctggagaccacgacgattctgctatgaagacactcaggagcaagatgggcaagtggtgctgccactgcttcccctggtgcagggggagcggcaagagcaacgtgggcacttctggagaccacgacgattctgctatgaagacactcaggagcaagatgggcaagtggtgctgccactgcttcccctgctgcagggggagcggcaagagcaacgtgggcacttctggagaccacgacgactctgctatgaagacactcaggagcaagatgggcaagtggtgctgccactgcttcccctgctgcagggggagcggcaagaacaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgactaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaac

SEQ ID NO: 168395 - DNA, 1964 bp, Homo sapiens
  Payload ID: 13144
  Gene Symbol: POTEH
  Gene Name: POTE ankyrin domain family, member H
  ENST ID: ENST00000452800
  CDS Start-End: 1-912
ctcaggagcaagatgggcaagtggtgctgccactgcttcccctggtgcagggggagcggcaagagcaacgtgggcacttctggagaccacgacgattctgctatgaagacactcaggagcaagatgggcaagtggtgctgccactgcttcccctgctgcagggggagcggcaagagcaacgtgggcacttctggagaccacgacgactctgctatgaagacactcaggagcaagatgggcaagtggtgctgccactgcttcccctgctgcagggggagcggcaagaacaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagattgagtctcactctgtttcccaggctggagtgcagtggtgtgatcacagctcactgcaacctcgacctcccgaagctcagatggtcctccaacctcaacctcagttgtttttttctttctttctttttatttttatttttatttttatttttttttagtagagatttggtttttgccatgtttctcaggctggtcttgaactcctgggctcaagcaattcatccccctcagcctcccaaagtgctaggattacagcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgactaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaac

SEQ ID NO: 168396 - DNA, 1874 bp, Homo sapiens
  Payload ID: 13144
  Gene Symbol: POTEH
  Gene Name: POTE ankyrin domain family, member H
  ENST ID: ENST00000621704
  CDS Start-End: 1-1527
atggtggctgaggctggttcaatgccggctgcctcctctgtgaagaagccatttggtctcagaagcaagatgggcaagtggtgccgccactgcttcgcctggtgcagggggagcggcaagagcaacgtgggcacttctggagaccacgacgattctgctatgaagacactcaggagcaagatgggcaagtggtgctgccactgcttcccctggtgcagggggagcggcaagagcaacgtgggcacttctggagaccacgacgactctgctatgaagacactcaggagcaagatgggcaagtggtgctgccactgcttcccctgctgcagggggagcggcaagaacaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgactaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacataatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaacggctctggcatgtgcaaggccggctttgcaggtgacgatgccccccgggctgtcttcccttccatcgtggggtgccccaggcaccagaacatgatggggggcatgcgtc

SEQ ID NO: 168397 - DNA, 7020 bp, Homo sapiens
  Payload ID: 13145
  Gene Symbol: POTEI
  Gene Name: POTE ankyrin domain family, member I
  Uniprot ID: P0CG38
  ENST ID: ENST00000451531
  CDS Start-End: 432-3659
taactgcttggctggcctgtagcggcttggcttggctttgcgttctttgcttggcttggtgttggtcgcttggcctggtgttcctccttggattgacgtttcctccttggattggcgtttcctctctcgcgttcccttgctaggcttgaccttttctctgctgggtttggcattcccttgggtgggctgggtgttttcttgggggggggggttggcccttcctcgggtgggcgtgggctttccccgggtgggtgtgggttttccctgggtggggtgggttgggcttacctgctggggttggcaggttttggctgggattgacttttctcttcaaacagattggaaacccggagttacctgctagttggtgaaactggttggtagacgtgatctgctcgctactaccggcctccccaggctgttaaaagcagatggtagctgaggttgattcaatgccggctgcctcttctgtgaagaagccatttgttctcaggagcaagatgggcaagtggtgccgccactgcttcccctgctgcagggggagcggcaagagcaacgtgggcacttctggagaccaggacgactccactatgaagacactcaggagcaagatgggcaagtggtgctgccactgcttcccctgctgcagggggagtggcaagagcaacgtgggcacttctggagaccacgacgactccgctatgaagacgctcaggagcaagatgggcaagtggtgctgccactgcttcccctgctgcagggggagcggcaagagcaacgtgggtgcttggggagactacgacgacagcgccttcgtggagccgagataccacgtccgtcgagaagatctggacaagctccacagagctgcctggtggggtaaagtcgccagaaaggatctgatcgtcatgctcagggacactgacgtgaacaagcaggacaagcaaaagaggactgctctacatctggcctctgccaatgggaattcaggagtagtaaaactcctgctggacagacgatgtcaacttaatgtccttgacaacaaaaagaggacagctctgacaaaggccgtacaatgccaggaagatgaatgtgcgttaatgttgctggaacatggcactgatccaaacattccagatgagtatggaaataccactctacactacgctatctacaatgaagataaattaatggccaaagcactgctcttatacggtgctgatatcgaatcaaaaaacaagcatggcctcacaccactgctacttggtgtacatgagcaaaaacagcaagtggtgaaatttttaatcaagaaaaaagcgaatttaaatgcgctggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagagaggttgaagaagaaatgaagaagcatgaaagtaataatgtgggattactagaaaacctgagtaatggtgtcactgctggcaatggtgatgatggattaattcctcaaaggaagagcagaacacctgaaaatcagcaatttcctgacaacgaaagtgaagagtatcacagaatttgcgaattagtttctgactacaaagaaaaacagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcacgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacttcttgcatgaaaatagtacgttgcgggaagaaattgccatgctaagactggagctagacacaatgaaacatcagagccagctaagaaaaaagaaatatttggaggatattgaaagtgtgaaaaaaaagaatgataatcttttaaaggctctacaattgaatgagctcaccatggatgatgataccgccgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaagagaggcatcctgaccctgaagtaccccatggaacacggcatcatcaccaactgggatgacatggagaagatctggcaccacaccttctacaacgagctgcgtgtggcccctgaggagcaccccatcctgctgaccgaggcccccctgaaccccaaggccaaccgcgagaagatgacccagatcatgtttgagaccttcaacaccccagccatgtacgtggccatccaggccatgctgtccctgtacacctctggccgtactactggcatcgtgatggactctggtgacggggtcacccacactgtgcccatctatgatgggaatgccctcccccatgccaccctgcgcctagacctggctgggcgggaactgactgactacctcatgaagatcctcaccgagcgtggctataggttcaccaccatggccgagcgggaaatcgtgcgtgacatcaaagagaagctgtgctatgttgccctggacttcgagcaggagatggccatggcggcctccagctcctccctagagaagagctacgagctgcccgatggccaggtcatcaccatcggcaacgagtggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgttgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgtggccaaggactttgattgtacattgttcttcttttcaatagtcattccaaatattgtgagacgcattgtttcaggaagccccttgccctgctaaaagccaccccacttctctctaaggagaatggcccagtcctctccctagttcacacaggggaggtgatagcattgcttttgtgcagattacataatgcaaaattttttgaatcttcgccttaatactttttaattttgttttattttgaatgatcagccttcgtggcccccctcttttgtaccccaacttggggtgtatgaaggcttttggtctccctgagagtggctggaggcagccagggcttacctgtactctgacttgaggagagttggataaaagtgcacaccttaaaaaaaattgaggaagcacagtatttcagtacagtggacagcttagcatgttgacaactgagaataaaatgctcagttctgaactggacaatgtaagacacaacgaggaaacaccggaaatggaaattcaattacgtcattgtagactggctgctgctctacatgattgtgaccaaagtcagatagctgaaagagacttctttccagagaacaagacatgaacaggtttatttacagaagacaatgaattctcatttatctcacctaaaagagaacagattctttctcaacaagtctaacgtagacagtaaaatcaacaggctaaaaattaagctccatgaaacaagataaaactctgagagaaaagacggggcaggccgccatctttcccgttcaggcaacttagtcattccagcctgcgggctttggagagtacaaaccgacgagggacagaagagatcccacagcacagcatagctgctttaccaaatcatggccagactgcttctgtaagcaggcccctgatcctgttccatctcactggacaggacctcccaactggggcctccagctacccccaccagcattccttggccaatggaaatgtgaaatgttcctgggacagagctcccggagaggggcaggcccccacctttgctctttcggtgactagccattctggcctgcgggctttggagagcccaagctgacaaggggtggaagaggtacctcagcacagcacagccacgctaccaaaacgtggccagactcttgtttacgtcagtccctgaccacatttctagtcagtgggtgaagtctttcaaccagggtctctggctaccttgactgctgttctctggccgacagaggtctcaggcctccctgagtcagagctcccagggggaggaccagattgtcatctttgctgttggggcgacccaggcatttcagccttagggcttcagagtgtctgaggcggaccaggggctgaagtgaacccccagcacagcacagctgctctataaaaacgtggccagacttttctttttgaagcaagtccctgttcttgttcgtcctgactaggtaagacttctcaacttgcctccagccacatcttataggtgtgttcagattggcaacaggttcgtacctcagtggtacagagcttccagaggaaggggcagactatcatcttccctggaaaatacaaggcaattagggactggaggggacccccagcataccacagcagccctacagaaaagtggccaggctctctacttgatgggcagatcctcctggcctgggtctctagccagcccaccactggagctatcaagccagtagcaactctgcagttcctgggacagagcttccaggagcaaatgaaatcctttctgccactgcctctgcagtggaactgcccttgctgccctcagaagatgcaagggagcaaagaccctaagtgccctatcaacacctccaataagctgcagttgacccaaagaacaagccagtccatctcccacgggtaccacacaccctccactactcatcaccagacagggaaccctggcttgggcccacagcacagaccctccatcctgggctgattacactaagtgattgctaactcacatgtctctgggatggagcacccaggaaacaagcaaagtggtggagcagcaagtcaggtgatgtggagcccagaggtcagggatggctgtctctctagggtccacttgcccttgtgagacactttatcccagcactttaggaatactgaggtcataccagccacatcttatatgcaagattgcccagcagagatcaggtccgagagttccctttttaaaaaaaggagacttgcttaataaaagaagtctagccacgtttgtgtagagcggctgtgctgtgctgggggttcacttttgagagagttctcctctgagacctgatctctggaggctgggcaatcttgcacttgagatggggctggtctgatctcagcactccttagtctgctcgcctctcccatggccccagcctggccacacctgcttacggggcactcttagatgcccacaccatagcttccgtgctagtggactgtaccatatcagtggagagctgcagcaaggtggcccctagagccacgcaccagcctgcacattgcctctccatacggcagccctttatttggaaacttcctaaatcactttgctgtgtgtgtttacacgggtgggttttgctttacttgccctgagagcacacaggagtgcagcacacaccccaacccacatcaactgccattaaagaaaagaaatttcagcccagaatttcatgtccagcaaaattaagcatcataagtgaaggagaaataagatccttttcagacaagcaagtgctgagggaatttggtatcaccagatctaccttacgagagctcctgaaggaagcactaaatatggaaagaaaagatcatcacctgctactacaaaaacacactgaagtacacagtccaatgatgctaaaaagcaagcacatatgtaagtctgcaaaataaccagctgacagcatgacgacaggataaaatccacacataccattactaaccttaaatgtaaatgggctaaatgctcccattgaaagacacggggcaagctgggtaaagaaccaagacccactggagtatgccgtcttcaagcaacccatctcacgtgcagtgccatacataggctcaaaataaaggaatggagaaaaatatttcaag

SEQ ID NO: 168398 - DNA, 1926 bp, Homo sapiens
  Payload ID: 13145
  Gene Symbol: POTEI
  Gene Name: POTE ankyrin domain family, member I
  ENST ID: ENST00000615053
  CDS Start-End: 53-1579
ggtagacgtgatctgctcgctactaccggcctccccaggctgttaaaagcagatggtagctgaggttgattcaatgccggctgcctcttctgtgaagaagccatttgttctcaggagcaagatgggcaagtggtgccgccactgcttcccctgctgcagggggagcggcaagagcaacgtgggcacttctggagaccaggacgactccactatgaagacactcaggagcaagatgggcaagtggtgctgccactgcttcccctgctgcagggggagtggcaagagcaacgtgggcacttctggagaccacgacgactccgctatgaagacgctcaggagcaagatgggcaagtggtgctgccactgcttcccctgctgcagggggagcggcaagagcaacgtgggtgcttggggagactacgacgacagcgccttcgtggagccgagataccacgtccgtcgagaagatctggacaagctccacagagctgcctggtggggtaaagtcgccagaaaggatctgatcgtcatgctcagggacactgacgtgaacaagcaggacaagcaaaagaggactgctctacatctggcctctgccaatgggaattcaggagtagtaaaactcctgctggacagacgatgtcaacttaatgtccttgacaacaaaaagaggacagctctgacaaaggccgtacaatgccaggaagatgaatgtgcgttaatgttgctggaacatggcactgatccaaacattccagatgagtatggaaataccactctacactacgctatctacaatgaagataaattaatggccaaagcactgctcttatacggtgctgatatcgaatcaaaaaacaagcatggcctcacaccactgctacttggtgtacatgagcaaaaacagcaagtggtgaaatttttaatcaagaaaaaagcgaatttaaatgcgctggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagaaaggttgaagaagaaatgaagaagcacggaagtactcacgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaatgaattctgagctttctcttagttgtaagaaagaaaaagacttcttgcatgaaaatagtacgttgcgggaagaaattgccatgctaagactggagctagacacaatgaaacatcagagccagctaagaaaaaagaaatatttggaggatattgaaagtgtgaaaaaaaagaatgataatcttttaaaggctctacaattgaatgagctcaccatggatgatgataccgccgtgctcgtcattgacaacggctctggcatgtgcaaggccggctttgcgggcgacgatgccccccgggctgtcttcccttccatcgtggggcgccccaggcagcagggcatgatggggggcatgcatc

SEQ ID NO: 168399 - DNA, 2072 bp, Homo sapiens
  Payload ID: 13145
  Gene Symbol: POTEI
  Gene Name: POTE ankyrin domain family, member I
  ENST ID: ENST00000631234
  CDS Start-End: 53-1183
ggtagacgtgatctgctcgctactaccggcctccccaggctgttaaaagcagatggtagctgaggttgattcaatgccggctgcctcttctgtgaagaagccatttgttctcaggagcaagatgggcaagtggtgccgccactgcttcccctgctgcagggggagcggcaagagcaacgtgggcacttctggagaccaggacgactccactatgaagacactcaggagcaagatgggcaagtggtgctgccactgcttcccctgctgcagggggagtggcaagagcaacgtgggcacttctggagaccacgacgactccgctatgaagacgctcaggagcaagatgggcaagtggtgctgccactgcttcccctgctgcagggggagcggcaagagcaacgtgggtgcttggggagactacgacgacagcgccttcgtggagccgagataccacgtccgtcgagaagatctggacaagctccacagagctgcctggtggggtaaagtcgccagaaaggatctgatcgtcatgctcagggacactgacgtgaacaagcaggacaagcaaaagaggactgctctacatctggcctctgccaatgggaattcaggagtagtaaaactcctgctggacagacgatgtcaacttaatgtccttgacaacaaaaagaggacagctctgacaaaggccgtacaatgccaggaagatgaatgtgcgttaatgttgctggaacatggcactgatccaaacattccagatgagtatggaaataccactctacactacgctatctacaatgaagataaattaatggccaaagcactgctcttatacggtgctgatatcgaatcaaaaaacaagcatggcctcacaccactgctacttggtgtacatgagcaaaaacagcaagtggtgaaatttttaatcaagaaaaaagcgaatttaaatgcgctggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccaggttgaagaagaaatgaagaagcatgaaagtaataatgtgggattactagaaaacctgagtaatggtgtcactgctggcaatggtgatgatggattaattcctcaaaggaagagcagaacacctgaaaatcagcaatttcctgacaacgaaagtgaagagtatcacagaatttgcgaattagtttctgactacaaagaaaaacagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcacgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacttcttgcatgaaaatagtacgttgcgggaagaaattgccatgctaagactggagctagacacaatgaaacatcagagccagctaagaaaaaagaaatatttggaggatattgaaagtgtgaaaaaaaagaatgataatcttttaaaggctctacaattgaatgagctcaccatggatgatgataccgccgtgctcgtcattgacaac

SEQ ID NO: 168400 - DNA, 3383 bp, Homo sapiens
  Payload ID: 13146
  Gene Symbol: POTEJ
  Gene Name: POTE ankyrin domain family, member J
  Uniprot ID: P0CG39
  ENST ID: ENST00000409602
  CDS Start-End: 53-3169
ggtagacgtgatctgctcgctactaccggcctccccaggctgttaaaagcagatggtagctgaggttgattcaatgccggctgcctcttctgtgaagaagccatttgttctcaggagcaagatgggcaagtggtgccgccactgcttcccctgctgcagggggagcggcaagagcaacgtgggcacttctggagaccaggacgactccactatgaagacactcaggagcaagatgggcaagtggtgctgccactgcttcccctgctgcagggggagcggcaagagcaacgtgggtgcttggggagactacgacgacagcgccttcgtggagccgagataccacgtccgtcgagaagatctggacaagctccacagagctgcctggtggggtaaagtcgccagaaaggatctgatcgtcatgctcagggacactgacgtgaacaagcaggacaagcaaaagaggactgctctacatctggcctctgccaatgggaattcaggagtagtaaaactcctgctggacagacgatgtcaacttaatgtccttgacaacaaaaagaggacagctctgacaaaggccgtacaatgccaggaagatgaatgtgcgttaatgttgctggaacatggcactgatccaaacattccagatgagtatggaaataccactctacactacgctatctacaatgaagataaattaatggccaaagcactgctcttatacggtgctgatatcgaatcaaaaaacaagcatggcctcacaccactgctacttggtgtacatgagcaaaaacagcaagtggtgaaatttttaatcaagaaaaaagcgaatttaaatgcactggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagagaggttgaagaagaaatgaagaagcatgaaagtaataatgtgggattactagaaaacctgagtaatggtgtcactgctggcaatggtgatgatggattaattcctcaaaggaagagcagaacacctgaaaatcagcaatttcctgacaacgaaagtgaagagtatcacagaatttgcgaattagtttctgactacaaagaaaaacagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcacgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaagagacttcttgcatgaaaatagtatgttgcgggaagaaattgccatgctaagactggagctagacacaatgaaacatcagagccagctaagaaaaaagaaatatttggaggatattgaaagtgtgaaaaaaaagaatgataatcttttaaaggctctacaattgaatgagctcaccatggatgatgataccgctgtgctcgtcattgacaacggctctggcatgtgcaaggccggctttgcgggcgacgatgccccccgggctgtcttcccttccatcgtggggtgccccaggcagcagggcatgatggggggcatgcatcagaaagagtcctatgtgggcaaggaggcccagagcaagagaggcatcctgaccctgaagtaccccatggaacacggcatcatcaccaactgggatgacatggagaagatctggcaccacaccttctacaacgagctgcgtgtggcccccgaggagcaccccatcctgctgaccgaggcccccctgaaccccaaggccaaccgcgagaagatgacccagatcatgtttgagaccttcaacaccccagccatgtacgtggccatccaggccatgctgtccctgtacacctctggccgtactactggcatcgtgatggactctggtgacggggtcacccacactgtgcccatctatgatgggaatgccctcccccatgccaccctgcgcctagacctggctgggcgggaactgactgactacctcatgaagatcctcaccgagcgtggctataggttcaccaccatggccgagcgggaaatcgtgcgtgacatcaaagagaagctgtgctatgttgccctggacttcgagcaggagatggccatggtggcctccagctcctccctagagaagagctacgagctgcccgatggccaggtcatcaccatcagcaacgagtggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgatgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgtggccaaggac

SEQ ID NO: 168401 - DNA, 1817 bp, Homo sapiens
  Payload ID: 13147
  Gene Symbol: POTEM
  Gene Name: POTE ankyrin domain family, member M
  Uniprot ID: A6NI47
  ENST ID: ENST00000547889
  CDS Start-End: 53-1579
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgatgattctgctatgaagacactcaggagcaagatgggcaagtggtgccgccactgcttcccctggtgcagggggagcggcaagagcaacgtgggcacttctggagaccacgacgactctgctatgaagacactcaggagcaagatgggcaagtggtgctgccactgcttcccctgctgcagggggagcggcaagagcaaagtgggcccctggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaattcttaatcaagaaaaaagcaaatttaaatgcactggatagatatggaagaactgttctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacgtaatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaac

SEQ ID NO: 168402 - DNA, 2073 bp, Homo sapiens
  Payload ID: 13147
  Gene Symbol: POTEM
  Gene Name: POTE ankyrin domain family, member M
  ENST ID: ENST00000552966
  CDS Start-End: 53-1021
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgatgattctgctatgaagacactcaggagcaagatgggcaagtggtgccgccactgcttcccctggtgcagggggagcggcaagagcaacgtgggcacttctggagaccacgacgactctgctatgaagacactcaggagcaagatgggcaagtggtgctgccactgcttcccctgctgcagggggagcggcaagagcaaagtgggcccctggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagattgagtctcactctgtttcccaggctggagtgcagtggtgtgatcacagctcactgcaacctcgacctcccgaagctcagatggtcctccaacctcaacctcagttttttttttctttctttctttttatttttatttttatttttatttttttttagtagagatgaggtttttgccatgtttctcaggctggtcttgaactcctgggctcaagcaattcatccccctcagcctcccaaagtgctaggattacagcatggcctcacaccactgttacttggtgtacatgagcaaaaacagcaagtggtgaaattcttaatcaagaaaaaagcaaatttaaatgcactggatagatatggaagaactgttctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacgtaatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaac

SEQ ID NO: 168403 - DNA, 1975 bp, Homo sapiens
  Payload ID: 13147
  Gene Symbol: POTEM
  Gene Name: POTE ankyrin domain family, member M
  ENST ID: ENST00000616847
  CDS Start-End: 53-1513
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgatgattctgctatgaagacactcaggagcaagatgggcaagtggtgccgccactgcttcccctggtgcagggggagcggcaagagcaacgtgggcacttctggagaccacgacgactctgctatgaagacactcaggagcaagatgggcaagtggtgctgccactgcttcccctgctgcagggggagcggcaagagcaaagtgggcccctggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaattcttaatcaagaaaaaagcaaatttaaatgcactggatagatatggaagaactgttctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagggacttttctggccatcccaactttcccacgacccttcccatcaaacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacgtaatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaacggctctggcatgtgcaaggccggctttgcaggtgacgatgccccccgggctgtcttcccttccatcgtggggtgccccaggcaccagaacatgatggggggcatgcgtc

SEQ ID NO: 168404 - DNA, 1491 bp, Homo sapiens
  Payload ID: 13148
  Gene Symbol: POU1F1
  Gene Name: POU class 1 homeobox 1
  Uniprot ID: P28069
  ENST ID: ENST00000350375
  CDS Start-End: 126-1001
ctcagagccttcctgatgtatatatgcaggtagtgagaattgaatcggccctttgagacagtaatataataaaactctgatttggggagcagcggttctccttatttttctactctcttgtgggaatgagttgccaagcttttacttcggctgatacctttatacctctgaattctgacgcctctgcaactctgcctctgataatgcatcacagtgctgccgagtgtctaccagtctccaaccatgccaccaatgtgatgtctacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccacttttttttaaaaaaaagaaaccaacaatttaaattatattgatgttatttacttaaaataattattctcagaagccacattatctattttaagccaaatatattaacagtaataaaatgatctctctgtctctcccgctctctttctcacacacacgcagacatatgagtatgggtttataagttccttttccaaacatgtatattagctttttaacatgtaagtcagtaatgacacatatgtaaagcacatcaccagaaatatccaattcaaaaattaaccaatgttctgctttctaccaactctactaatttgtctgaactaaaagttttgaacttaagagctggaggtgtcttata

SEQ ID NO: 168405 - DNA, 1149 bp, Homo sapiens
  Payload ID: 13148
  Gene Symbol: POU1F1
  Gene Name: POU class 1 homeobox 1
  Uniprot ID: P28069
  ENST ID: ENST00000344265
  CDS Start-End: 43-996
ggggagcagcggttctccttatttttctactctcttgtgggaatgagttgccaagcttttacttcggctgatacctttatacctctgaattctgacgcctctgcaactctgcctctgataatgcatcacagtgctgccgagtgtctaccagtctccaaccatgccaccaatgtgatgtctacagtcccatctattttgtctttgatccaaactcctaaatgtttgtgcacacatttctcggtgacaacgttgggaaacacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccacttttttttaaaaaaaagaaacc

SEQ ID NO: 168406 - DNA, 647 bp, Homo sapiens
  Payload ID: 13148
  Gene Symbol: POU1F1
  Gene Name: POU class 1 homeobox 1
  ENST ID: ENST00000560656
  CDS Start-End: 1-510
atgagttgccaagcttttacttcggctgatacctttatacctctgaattctgacgcctctgcaactctgcctctgataatgcatcacagtgctgccgagtgtctaccagtctccaaccatgccaccaatgtgatgtctacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcaga

SEQ ID NO: 168407 - DNA, 650 bp, Homo sapiens
  Payload ID: 13148
  Gene Symbol: POU1F1
  Gene Name: POU class 1 homeobox 1
  ENST ID: ENST00000561167
  CDS Start-End: 1-650
atgagttgccaagcttttacttcggctgatacctttatacctctgaattctgacgcctctgcaactctgcctctgataatgcatcacagtgctgccgagtgtctaccagtctccaaccatgccaccaatgtgatgtctacagcaacaggacttcattattctgttccttcctgtcattatggaaaccagccatcaacctatggagtgatggcaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagata

SEQ ID NO: 168408 - DNA, 3295 bp, Homo sapiens
  Payload ID: 13149
  Gene Symbol: POU2AF1
  Gene Name: POU class 2 associating factor 1
  Uniprot ID: Q16633
  ENST ID: ENST00000393067
  CDS Start-End: 516-1286
gcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccagctggctagctccgagtgtggagcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctgtctcacctctaggccctctgctggtgctgtggaggccaagaccccattaagcctaaaggtgatgggtcctcgcctaggcttagtgctaccatgtgggttttgtttctttccttccttccttccttccttccttccttccttccttccttccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgaccttgtgatccgcccgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaagtt

SEQ ID NO: 168409 - DNA, 524 bp, Homo sapiens
  Payload ID: 13149
  Gene Symbol: POU2AF1
  Gene Name: POU class 2 associating factor 1
  ENST ID: ENST00000531398
  CDS Start-End: 144-524
ataggcatgtcctgcatgctccctctttggaggcagaagtcacaggccctggctctgcatgagggaaacaattccaagaaaaaggacattcttcacccagcagctcctgccatattcactgagatgtgtttttgtattttcctatgtatttcttcatcagagatgccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcag

SEQ ID NO: 168410 - DNA, 13945 bp, Homo sapiens
  Payload ID: 13150
  Gene Symbol: POU2F1
  Gene Name: POU class 2 homeobox 1
  ENST ID: ENST00000271411
  CDS Start-End: 9-182
tattcaaaatggcggacggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctgactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattg

SEQ ID NO: 168411 - DNA, 14038 bp, Homo sapiens
  Payload ID: 13150
  Gene Symbol: POU2F1
  Gene Name: POU class 2 homeobox 1
  Uniprot ID: P14859
  ENST ID: ENST00000367862
  CDS Start-End: 236-2503
aaactcctctgagcaactgaagtttccttattcagttgaagattgctatggtgtaacagaagttgtattttgcttttccccttaatccactttccaccctacgcaacccccctcttttcgcttaagaacatactgtagatttgttagaaatagtagtaccttctttccccaccccaaactgctacctgtttcttccttgtttggactctctgctcctctagaagatttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattg

SEQ ID NO: 168412 - DNA, 13905 bp, Homo sapiens
  Payload ID: 13150
  Gene Symbol: POU2F1
  Gene Name: POU class 2 homeobox 1
  Uniprot ID: P14859
  ENST ID: ENST00000367866
  CDS Start-End: 70-2370
gggaggggggaggggagccagagcgagggagggtttatcgaccgggcgattttggttaaaatattcaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattg

SEQ ID NO: 168413 - DNA, 13651 bp, Homo sapiens
  Payload ID: 13150
  Gene Symbol: POU2F1
  Gene Name: POU class 2 homeobox 1
  Uniprot ID: P14859
  ENST ID: ENST00000429375
  CDS Start-End: 8-2119
attcaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactggggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcaca

SEQ ID NO: 168414 - DNA, 496 bp, Homo sapiens
  Payload ID: 13150
  Gene Symbol: POU2F1
  Gene Name: POU class 2 homeobox 1
  ENST ID: ENST00000442313
  CDS Start-End: 8-190
attcaaaatggcggacggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctggttttcttccatcatctgtgacagcttcttgatctgtccccagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttca

SEQ ID NO: 168415 - DNA, 1896 bp, Homo sapiens
  Payload ID: 13150
  Gene Symbol: POU2F1
  Gene Name: POU class 2 homeobox 1
  ENST ID: ENST00000420254
  CDS Start-End: 114-1896
taagaacatactgtagatttgttagaaatagtagtaccttctttccccaccccaaactgctacctgtttcttccttgtttggactctctgctcctctagaagatttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaag

SEQ ID NO: 168416 - DNA, 12939 bp, Homo sapiens
  Payload ID: 13150
  Gene Symbol: POU2F1
  Gene Name: POU class 2 homeobox 1
  ENST ID: ENST00000443275
  CDS Start-End: 1-1686
gtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcaca

SEQ ID NO: 168417 - DNA, 13937 bp, Homo sapiens
  Payload ID: 13150
  Gene Symbol: POU2F1
  Gene Name: POU class 2 homeobox 1
  Uniprot ID: P14859
  ENST ID: ENST00000541643
  CDS Start-End: 171-2402
atggcggacggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctgactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattg

SEQ ID NO: 168418 - DNA, 1195 bp, Homo sapiens
  Payload ID: 13150
  Gene Symbol: POU2F1
  Gene Name: POU class 2 homeobox 1
  ENST ID: ENST00000560232
  CDS Start-End: 8-181
attcaaaatggcggacggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctgactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagatctggcccagtccagcctgaggtttctggagctggggtaacttatctgtaaccaccccatctaaagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatat

SEQ ID NO: 168419 - DNA, 3730 bp, Homo sapiens
  Payload ID: 13151
  Gene Symbol: POU2F2
  Gene Name: POU class 2 homeobox 2
  ENST ID: ENST00000342301
  CDS Start-End: 66-1826
ctcggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggaagcacaatggtggggttgagctccgggctgagtccagccctcatgagcaacaaccctttggccactatccaagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaa

SEQ ID NO: 168420 - DNA, 6901 bp, Homo sapiens
  Payload ID: 13151
  Gene Symbol: POU2F2
  Gene Name: POU class 2 homeobox 2
  Uniprot ID: P09086
  ENST ID: ENST00000389341
  CDS Start-End: 68-1459
ggctcggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaaaaaaaaaaaaaaaaaaggaaagaaaatccaggactcaccaccacccacttcatcctgcttcctccccatcaagtcccaccacctgggacctctccccaccccagtatgtgggagtggggtaaagaggagaggaggagcagggggcagggatggggcagatgccctgatgttggtggagggacccctgtgcagccgggggtgctggggaccctccccatccaaccctcacacctaggaaaagaaaaacaagaaaaaaaaattcctgggagggggaaaaataaccaaatcccaagctttaactacagctgtgaaaccaaatattgggaagggggtaggagggagggaggggcaggtgagccccaggtctccccctgggcccccctcccctgaggactcgagataaggcaccaaatacctcatagaactttaatgttaaaaaaaggaaaccaaatatcgttggctgggggccagccagggcaaggggctggggggctggagggagccagggttgggaaggtgatgggggaattcatgccccccacccccatctgccccttacactctggtcccccgtctcgactccgggaaacaaaactatctcatcgtttttattttgtggtctgtacagagcctgtgtccgtgtgtctgtgtatgagcgagagagttggagggctggggagctttatgtgggggatggggagggcaaccccaggctaggctatgggctaggttagatgtccgaggttgggggccaagggcctgggctagaaagagaggagagatgagtgggttggagcagtggggagccctctgaatttctcttctccccaaccctgacctcctacttaagggagggacagagactgggtctaccctaatggtgggccttttcattgtgccaaaaaaaaaaaaaaaaaaattgatgccagtaactaaaccacctctctctgttctcttctggggggtggggtgggtgtgtgtgtgggggtgggtagggatggggaacccaagccccagtaggagttggggctgagatcaggaggaggggaaggatatgagttttccatccatctccctggagaaggccatgacgggctctccaagccctggggagatctggcgagggactagccaagtcagggtgacctcttgacctgactagtttttctaacccacatgaacaccagggtgcctctctcttcctctagcccagggtagggggacctgagtgagagagagagtgagacagacagcaagattgagacacgcgggcccccactggtctctgagtgggaaaggcaagtgcgagagataaaggcctccaagagaaaaaagaaacaaaccaaagatttaaccatttaaaaaaaaaaaaaaacccacagacaactccgctacctttttatatgttggaaaaaaagtgaaaaaaaattaaaaataaaaataaaaaaaaatacacaaaaactccaagccgcaagtccttcatgcggtttaaactttgacctcagcagtctccaaagcaagacgacgatgacaaaggcggaaacaaagaaaaaataatgtatatttttaagtatttgtccttgaattgttagctccttgttaaacaaacaaaaggagagaaaaatccagagagaagtgttgctgggatggagacaactatttactatgtctgtgacccctcccttctgcctccctccccttcctctctttcctgtcctctatccttgctgcccctcccccaatatgtcccccaaacccaggggctcagtatttatttatttatataattgcagggtgactgggggcctctctcggcaactcgtagagagcctttggataatggcagggtggggaatgggcgaggagtctttgggaagagcaggggcctgaactttcaactcctttctggcctcttgtcccactgcttccaccatcaccttccaaatccagggctgcactagggcaaggtgaccaccctacttggtaaagacctgattggcgcagcccattctggtgtgggtgtctttcaccacccagaatgaccaggttggaatgggggtgggtgaagttggagggggtggcaagtacaaggcaagggtgcccaggaaccggcatccagaaatcagccctggagtagacctgcctttcctccatccttaccaagttagcctccctttcagttccgtctgacccctgtgttggtagccccttccttcccttcctgtaccccctccgtctcttctcgtggtagcgggttagtgtttcagtgttcttaactccaatctgcttgttcattgtacaatgtgcttcttttaaggccccatttttgtaacttgagtgtgtcattcatctgaacaacaaacatcaaaaaataaaaaattaaaaactgtacagagagaaatga

SEQ ID NO: 168421 - DNA, 3218 bp, Homo sapiens
  Payload ID: 13151
  Gene Symbol: POU2F2
  Gene Name: POU class 2 homeobox 2
  Uniprot ID: P09086
  ENST ID: ENST00000526816
  CDS Start-End: 17-1456
tggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaa

SEQ ID NO: 168422 - DNA, 2003 bp, Homo sapiens
  Payload ID: 13151
  Gene Symbol: POU2F2
  Gene Name: POU class 2 homeobox 2
  ENST ID: ENST00000534559
  CDS Start-End: 46-399
gggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctgggctccatgaagtaagacttattgtggtgtcacctgaggaaactgaggcttaaagaggttaaggaggctggggcccagagggaaagtggcttcccccaggcacacagcaagaagcaggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcagg

SEQ ID NO: 168423 - DNA, 1716 bp, Homo sapiens
  Payload ID: 13151
  Gene Symbol: POU2F2
  Gene Name: POU class 2 homeobox 2
  Uniprot ID: P09086
  ENST ID: ENST00000529952
  CDS Start-End: 63-1466
ggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacggggtaagtgggtgcacgtgggaagctgtggggagaagcagggtcgctgctgcttctagggtggggagcggcaccccagttatgttggcaggtccctgcccctgctaatgcctctgctttgcctcttgcagaagcacaatggtggggttgagctccgggctgagtccagccctcatgagcaacaaccctttggccactatccaaggtgcgtgctgcctcatgtcacacccatcgtcaccagccctatcctctggggc

SEQ ID NO: 168424 - DNA, 2657 bp, Homo sapiens
  Payload ID: 13151
  Gene Symbol: POU2F2
  Gene Name: POU class 2 homeobox 2
  Uniprot ID: P09086
  ENST ID: ENST00000529067
  CDS Start-End: 55-1257
gagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaa

SEQ ID NO: 168425 - DNA, 2269 bp, Homo sapiens
  Payload ID: 13151
  Gene Symbol: POU2F2
  Gene Name: POU class 2 homeobox 2
  ENST ID: ENST00000560804
  CDS Start-End: 1-1857
agcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaaggtgggcattctctctggcctccacttaacattctggggtcccggaccctgcctctctcccccccagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggaagcacaatggtggggttgagctccgggctgagtccagccctcatgagcaacaaccctttggccactatccaaggtgcgtgctgcctcatgtcacacccatcgtcaccagccctatcctctggggcctcgagccctgccattgctgctccagccatgccatcctgcccctgctcactgcattgcttgcctcttcatacccatctcacctttggggaaggtgtgaggggtgctgatgggggtcagtgggaccgatggggagatggggggcactctgggcaggatgctggaaggcaaaggtctcccctggcccggcatgcccttagcccagcctctctctctccccgccagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaa

SEQ ID NO: 168426 - DNA, 1788 bp, Homo sapiens
  Payload ID: 13151
  Gene Symbol: POU2F2
  Gene Name: POU class 2 homeobox 2
  ENST ID: ENST00000560398
  CDS Start-End: 9-1466
cgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaaggtgggcattctctctggcctccacttaacattctggggtcccggaccctgcctctctcccccccagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattc

SEQ ID NO: 168427 - DNA, 693 bp, Homo sapiens
  Payload ID: 13151
  Gene Symbol: POU2F2
  Gene Name: POU class 2 homeobox 2
  ENST ID: ENST00000533548
  CDS Start-End: 1-596
aaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagaagcacaatggtggggttgagctccgggctgagtccagccctcatgagcaacaaccctttggccactatccaagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtc

SEQ ID NO: 168428 - DNA, 3282 bp, Homo sapiens
  Payload ID: 13151
  Gene Symbol: POU2F2
  Gene Name: POU class 2 homeobox 2
  ENST ID: ENST00000560558
  CDS Start-End: 9-1283
cgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaaggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaa

SEQ ID NO: 168429 - DNA, 673 bp, Homo sapiens
  Payload ID: 13151
  Gene Symbol: POU2F2
  Gene Name: POU class 2 homeobox 2
  ENST ID: ENST00000598842
  CDS Start-End: 1-373
gagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacaggtcagggagggcagaaaatggtgaggggggactgggaggatgtggcacaggctggagcctgaggttcccaagtggctctgggtgtccatgggcctcaagactgggcctggggagtgtgggtgggggaatgggagagacagtgggaagagggtaggactcacccctcctctgcaggagcaactcagctttaatctgcttcacgatttcatatgagaaaagcatgggcctggtaaaaggtgaggcacttgagttttgtgcctggcctctgtcatttttaagctgtgtgaattcaagcacttattttatccttctaagcctcagtttttattaaattattatgaatgtgtaaaacataaaaagat

SEQ ID NO: 168430 - DNA, 785 bp, Homo sapiens
  Payload ID: 13151
  Gene Symbol: POU2F2
  Gene Name: POU class 2 homeobox 2
  ENST ID: ENST00000528894
  CDS Start-End: 1-785
ggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcag

SEQ ID NO: 168431 - DNA, 660 bp, Homo sapiens
  Payload ID: 13151
  Gene Symbol: POU2F2
  Gene Name: POU class 2 homeobox 2
  ENST ID: ENST00000526831
  CDS Start-End: 1-660
ccgccgccgcctccgcctcctcctctacttcctcctcctcctcctcctctgcctcctcctcgacctcacagcccccagcctcctctggggggggtgacctgccaccaccacagcctgccagccagccccctgggaccccacagctcaccttgtcccaacccatccagctcacagcacaggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctgg

SEQ ID NO: 168432 - DNA, 195 bp, Homo sapiens
  Payload ID: 13151
  Gene Symbol: POU2F2
  Gene Name: POU class 2 homeobox 2
  ENST ID: ENST00000558596
  CDS Start-End: 1-195
ccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaaggtaagcacctgtcagaacagccagggaagtggg

SEQ ID NO: 168433 - DNA, 371 bp, Homo sapiens
  Payload ID: 13151
  Gene Symbol: POU2F2
  Gene Name: POU class 2 homeobox 2
  ENST ID: ENST00000625670
  CDS Start-End: 33-371
ctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctgggctccatgaagtaagacttattgtggtgtcacctgaggaaactgaggcttaa

SEQ ID NO: 168434 - DNA, 2903 bp, Homo sapiens
  Payload ID: 13152
  Gene Symbol: POU2F3
  Gene Name: POU class 2 homeobox 3
  Uniprot ID: Q9UKI9
  ENST ID: ENST00000260264
  CDS Start-End: 35-1351
ctcactccagcccagagctcaaaaaaccggtttcatggagtctccaagaactgctaaaggaggaagggatatcaagatgagtggggatgtagccgattccacggatgctcgcagcactctcagccaggtggagccaggaaatgatcgaaatggcctagatttcaacaggcagattaaaaccgaagatctcagtgactccctgcagcagaccctctcccatcggccatgccacctgagtcaaggacctgccatgatgtccggaaaccaaatgtctgggctaaatgccagcccatgtcaggacatggcttccctccatccgctccagcagcttgtgctggttcccggccacttacagtctgtatcccagttcctgctatctcagacccagcctgggcagcaaggtctgcagccaaatctcctcccctttccacagcaacaaagcggtctcctcctcccacagactgggccgggactggcatcccaggcatttgggcaccctgggctgccaggatcctctttagaaccccacctggaagcatcccagcatctcccagtgcccaagcatctacccagctctggaggggccgatgagcccagtgacctcgaggagctggagaagtttgccaagaccttcaagcagaggcgcattaagctgggcttcacacagggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagataacccaaaacccagctcggaggagatctccatgattgcagagcagttgtccatggagaaggaggtggtgagggtctggttctgcaaccgacgccaaaaggagaagcgaatcaactgccctgtggccacacccatcaaaccacctgtctacaactcccggctggtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcaggatcttggtaccgatggaatcattccacctacctccactgagaccaaaaagtttctcctactccagctggccctgtattccccctggaaggaagggaatcatgccttctatatacagacagattgccttcagaagagtggaagaaaatctccactatcaatgaacccagactcttgtcttcttcaagagcaagggcctccggagatccaaactgtgattgaaccaagtgcagactcctaatgctcttgaaatacacagcccctcctaggagcttaccattttcaccttccttgcctatgcccttgccttctagttccaaatattttagccagcttcactgtggcaatagtctttcagagaaaagacttcttgctgttattctccaactcatccgtgggcttctggggacagccatttggctggggtgccaaacaccagaaggggagataatagttttgactctgaacttggccacaacccctgaactgatcccaaaatctgtgaaaagatttgaatctgatatctccaccaaagccttgatgttttctctgtacagctaagttttctgatggaatcttcatctcaccccattttctttttaacctcgcccccttttctacaatcaaatccattcattattgcgccctccaggtcccctcctttttgcagaaggtgtaaaagagctgcccttggtgggtgccctgggcatgttgcaacgcctgctggtgcccttctgtctgtccacgtctgcctagggctcaggagtgcttgttctttcccttcctccctgtgtttctctttatcctgtcccctctcctttctcctggcagcagaaaaggaagaacacaagagcaaacacacaacaatgatggtggcaaagtacctgtatatagccctttcccattttttgcattatgttcttaactccttaatgtggaattttccagcaaaatgtttaactcaggtgtgatttttgaaaatgtctctgtaatattttatcttctttaaaaaaaagggggggaaataccaaagtgtgaaatactgtgctaccttccagagttcccacatgggctgggatttttttttctttttcttttttttttttttttttgagacagtcttgctccagcccaggctggagtgcagtggcatgatcttggctcactgcatgctctgccacttgggttcaagcgattctcctgcctcagcctctcaagtagcgggattacaggcgcccaccaccaaaaattagcccagctaatttttgtatttttagtagagatggggtttcaccatgttggtcaggctggtcttgaactcctgacctcctgatccacccacctcagcgtcccgaagtgctgggattacaggtgtgagccaccgcgcctggcctgggctgggaatctttgttgacttctttgggaacattatctctagagtctgcttttttgtgggccagtttgtagagatgtaacatgaagccattccagaaatggtaacttaaaaaaaaaaagactacatgtctaggaaactgttgagattcaaaggaatctcactgttcctaaataaatgtgtatagtgattatgaaaagt

SEQ ID NO: 168435 - DNA, 1488 bp, Homo sapiens
  Payload ID: 13152
  Gene Symbol: POU2F3
  Gene Name: POU class 2 homeobox 3
  ENST ID: ENST00000533620
  CDS Start-End: 84-464
agaccctggcttcgcaggggccccggctggggcagaggcgaggggcctgggggggcgctggctttggccccgcctggggcaggatggtgaatctggagtccatgcacacagatatcaagatgagtggggatgtagccgattccacggatgctcgcagcactctcagccaggtggagccaggaaatgatcgaaatggcctagatttcaacaggcagattaaaaccgaagatctcagtgactccctgcagcagaccctctcccatcggccatgccacctgagtcaaggacctgccatgatgtccggaaaccaaatgtctgggctaaatgccagcccatgtcaggacatggcttccctccatccgctccagcagcttgtgctggttcccggccacttacagtctgtatcccagttcctgctatctcagacccagcctgggcagcaagaagactggagagcgacatgaaaatggcccaggcttataaccacctaggtctgcagccaaatctcctcccctttccacagcaacaaagcggtctcctcctcccacagactgggccgggactggcatcccaggcatttgggcaccctgggctgccaggatcctctttagaaccccacctggaagcatcccagcatctcccagtgcccaagcatctacccagctctggaggggccgatgagcccagtgacctcgaggagctggagaagtttgccaagaccttcaagcagaggcgcattaagctgggcttcacacagggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagataacccaaaacccagctcggaggagatctccatgattgcagagcagttgtccatggagaaggaggtggtgagggtctggttctgcaaccgacgccaaaaggagaagcgaatcaactgccctgtggccacacccatcaaaccacctgtctacaactcccggctggtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcaggatcttggtaccgatggaatcattccacctacctccactgagaccaaaaagtttctcctactccagctggccctgtattccccctgga

SEQ ID NO: 168436 - DNA, 1953 bp, Homo sapiens
  Payload ID: 13152
  Gene Symbol: POU2F3
  Gene Name: POU class 2 homeobox 3
  Uniprot ID: Q9UKI9
  ENST ID: ENST00000543440
  CDS Start-End: 151-1461
gcgacagtggcggcgacggctccggcagcggctcccgcggcggcggcggccgggaactggaggaaggagaccctggcttcgcaggggccccggctggggcagaggcgaggggcctgggggggcgctggctttggccccgcctggggcaggatggtgaatctggagtccatgcacacagatatcaagatgagtggggatgtagccgattccacggatgctcgcagcactctcagccaggtggagccaggaaatgatcgaaatggcctagatttcaacaggcagattaaaaccgaagatctcagtgactccctgcagcagaccctctcccatcggccatgccacctgagtcaaggacctgccatgatgtccggaaaccaaatgtctgggctaaatgccagcccatgtcaggacatggcttccctccatccgctccagcagcttgtgctggttcccggccacttacagtctgtatcccagttcctgctatctcagacccagcctgggcagcaaggtctgcagccaaatctcctcccctttccacagcaacaaagcggtctcctcctcccacagactgggccgggactggcatcccaggcatttgggcaccctgggctgccaggatcctctttagaaccccacctggaagcatcccagcatctcccagtgcccaagcatctacccagctctggaggggccgatgagcccagtgacctcgaggagctggagaagtttgccaagaccttcaagcagaggcgcattaagctgggcttcacacagggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagataacccaaaacccagctcggaggagatctccatgattgcagagcagttgtccatggagaaggaggtggtgagggtctggttctgcaaccgacgccaaaaggagaagcgaatcaactgccctgtggccacacccatcaaaccacctgtctacaactcccggctggtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcaggatcttggtaccgatggaatcattccacctacctccactgagaccaaaaagtttctcctactccagctggccctgtattccccctggaaggaagggaatcatgccttctatatacagacagattgccttcagaagagtggaagaaaatctccactatcaatgaacccagactcttgtcttcttcaagagcaagggcctccggagatccaaactgtgattgaaccaagtgcagactcctaatgctcttgaaatacacagcccctcctaggagcttaccattttcaccttccttgcctatgcccttgccttctagttccaaatattttagccagcttcactgtggcaatagtctttcagagaaaagacttcttgctgttattctccaactcatccgtgggcttctggggacagccatttggctggggtgccaaacaccagaaggggagataatagttttgactctgaacttggccacaacccctgaactgatcccaaaatctgtgaaaagatttgaatctgatatctccaccaaa

SEQ ID NO: 168437 - DNA, 482 bp, Homo sapiens
  Payload ID: 13152
  Gene Symbol: POU2F3
  Gene Name: POU class 2 homeobox 3
  ENST ID: ENST00000532663
  CDS Start-End: 1-482
ggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagatgtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcagg

SEQ ID NO: 168438 - DNA, 2968 bp, Homo sapiens
  Payload ID: 13153
  Gene Symbol: POU3F1
  Gene Name: POU class 3 homeobox 1
  Uniprot ID: Q03052
  ENST ID: ENST00000373012
  CDS Start-End: 52-1407
cgcagacggagcggagcggcggcggcggcgcggcgcagggcgcggggcggcatggccaccaccgcgcagtacctgccgcggggccccggtggcggagccgggggcaccgggccgcttatgcacccggacgccgcggcggcggcggcggcggcggcggccgcggagcgattgcatgcaggggccgcgtaccgcgaagtgcagaagctgatgcaccacgagtggctgggcgcgggcgcgggccaccccgtgggcctagcgcacccccagtggctacccacgggaggaggcggcggcggcgattgggccggcggcccgcacctagaacacggcaaggcaggcggcggcggcaccggccgagccgacgacggcggcggcggcggaggtttccacgcgcgcctggtgcaccagggggcggcccacgcgggcgcggcatgggcgcagggcagcacagcgcaccacttgggcccggccatgtcgccctcgcccggggccagcgggggccaccagccccagccgctcgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcgagcactcggacgaggatgcgcccagctcggacgacctggagcagttcgccaagcagttcaagcagcggcgcatcaagctgggctttacgcaggccgacgtggggctggcgctgggcacgctctacggtaacgtgttctcgcagaccaccatctgccgcttcgaggccctgcagctgagcttcaagaacatgtgcaagctcaagccgctgctcaacaagtggctggaggagaccgactcgtccagcggcagccccaccaacctggacaagatcgcggcgcagggccgcaagcgcaagaagcgcacgtccatcgaggtgggggtcaaaggcgcgctcgagagccactttctcaagtgccccaagccctcggcgcacgagatcaccggcttggcagacagcctgcagctggagaaggaggtggtgcgcgtctggttctgcaaccggcggcagaaggagaagcgcatgacccctgcggccggcgcgggccacccgcccatggacgatgtatacgcgcctggggagctagggcctggcgggggcggcgcatcgccaccctccgcgcccccaccgcccccgccggcggcgctgcaccaccaccaccaccacacactgcccggctcagtgcagtgaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccggtaggctgcgtcgcccgagccccgggagagaggagcgaagatccggaactcgccaactcaccccgggcatcctgcccgccgcctgctctctgcccccatcccctcgacgacccccgcccctgcccccccgggctgttcggggccggatcccggcagcggcctccccaaagcgacaggtaacgcagtgcggggttagggattccccgggagagaggacgaagcgaggagagttctccatcccctctccccgcgtggactcctgagcctgcgggtccagggtggggggctgtcactttattcgctacacgcctcttctctcctataaggatgcgccccaccccgctttcccctttctccgggcttggttttttacggtttttatttattcgtggagcctctcggctcctggggtccttctaactccgcccgcgcccttaatttaaatcgcagtatactgtatttatcggggccccggaggggaggtcgcgagagccgcgtctgtgtataaaagcaggaaatagccaaagctttaatctagcctaatttatttttccccttatatttccctaccctaccctccccccaaaaaaaagcaaaaaaaaaaaaaaaaaactaacaaaaaaaattcgagtgttcatttttcgtttcgtttcatccgagccccggcttggttcccggccacgccggaggggtctgcgctcccacacacccagacgggaaggggcttctgccctgctgcagaccgaccgccgcatagcgcggcccctgctccccgcggggccctgccctcctggccacaccaaacgaaacttggaaaagttagagagattgttttttaaccagctgtagaaataagccgttccctgagaaccctccgcctgattccctgcagcttccctctgctccctttccagcccgccgggatgcgggatgccaggggaggccgggagagaaattccccaagtttggggtgaggtgggaaccatgtaaatatgtgagatatgtacacactggcggggagaagaaacattttgtgcttggtttttatttttggttttccgggttacccttccttcctaccctaaaggattttgtacactgactaatccgaaaaagatattttaatatgatttccgaatttctgacccatctctatttattttctggatgtgtttggagcttcccccttctccgtttcttcttctgtttgttaaggtttgaatttaaattttgttattttatttttattattttttgaaacaatgtttcggtgcattctctttgtatctttattgaaaaaaaaataatgtagactgggaagttccctttatatttatgttatagtaaatattttattactcacataaacatgtaccccagg

SEQ ID NO: 168439 - DNA, 4899 bp, Homo sapiens
  Payload ID: 13154
  Gene Symbol: POU3F2
  Gene Name: POU class 3 homeobox 2
  Uniprot ID: P20265
  ENST ID: ENST00000328345
  CDS Start-End: 283-1614
gggagaggggggagcgccgagctagtcagagagtgagcgagagcgagaaggagggagaggaggagaaagagagcgagggcgggcgggaggcggcggcggcggcagcagcagcagtaatagcaggagcagcaacagaaggcgtcggagcgggcgtcggagctgcccgctgtgggagagagaggagacagaaagagcgagcgaggagagggagcccgaggcgaaaaagtaactgtcaaatgcgcggctcctttaaccggagcgctcagtccggctccgagagtcatggcgaccgcagcgtctaaccactacagcctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccagcttcacggtgaacggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtgaactcgagctgggggaggggcagagcgcggggctccccctccccttcggtccttggccctttcccggccctcttgttccctctctaacttctgattgttcttttatttttaattattatttccccgtcccttaaaaagacaaaaaaaataaggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgtggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgagggtgtaacatctatttgttcctcttaccaaagcaaaaggattggcttcatacaaaatagacaattctctgatttcaggaaatgtgcatggtctacccgctttatcgaaggcaagaatccggtttggaatataaaaataagcattggttgttcttaccagccacaaagtaaacttcattttcaggcagtgtttctgggggaggttatggagggaagaaaaaagaaaaatcgatagtgagtgactgattgcttcattttatcaggcgggcccattgtgaaagagctcaggggaaatgtggaggttaaatatatttccagagttgtccagcagaaagaaagtggcactttgaagagaactagggaagtacatatcttcagatatccctatatagttctctaccttcagttttagtaacaattatgaagaattatttgtgctgacagcagcagttaaactttgtttctctaatagctttttttttacataaaaaaagacccaggaacttaatagtgtatgcataagactgtgttttttagcacacagatacccacagcatacactgacgatctccacgcagtagacaggttttgtcttcactagctcatttgtttatcaagtcatatttagggtcccacaccctcttttcctgtaatttattgcagaatacaccactttgacttggacagctttctgccccctctttcactaaggaaggcaaatgaagtgaaaaaaaaaaatgccattttcaatccttcctttctcccctttgttaatagttttaagtgaatttttgaccttatcttaatggaaaacggttaactccaaacacaaaagactctactggaaagtgtaggtgaaaaaacttgtaactgtattgaaaataaataccattaaactgtgatcagttaaaatttaaaagaaaaatcagcacaaaagggcgctaaaagggaaaacactttttattaatcttaaaagtttgggggtttttttccagttaggtattagataaatttttattttaaaaaatgaaagtctcactaccataaaattatggttcagcatcagattagcattgcactcagtagtctttaaggttttaggaaatatgctttatattgtcttttcaaacacctgtgattgtttcattttccatgtttttgcaagataaatggtgacttataatgggcatatttatttgcctgtatttcatttcccccaatgaatgtcacaaggagatgggcacggagctgcttcgggtgcatcacgctgctcgttcctgaggtatgggaactggcctttagtgaagctatccagagcagggcaaatagccactggtaaagggaggaaatgaatttccagatacttattaccaagtaggtaaggtcagaagctggagttcagagaatgtgtctacagcttctctgactcttataggtttactaagatgaaagttaccactgaaccttaccactatgtatatatgtttaatatctgtcttttgaaatgcagaaatagtttaaatgtttctttgtctatttttctttttttttaatgctacccagggaaatattttcatatcatttttaagtggcctgcctcaatgtatatttatttcttttgaaacaaaaaggttctggaaactgtttttctgtagctttaaatgaataggtgagcaaaatctatatgggatgtaatttttttgttcagtctcttaaaaaatactttgttttggtacatttggttgtgcttgtggggaaaataaaaacgcagagatccttatatatttatgttaaagtaatattttattatctacataaaacagaaatgcacaataccttcatagtttgttctaattattgaaatatctttattttatttttaaagatagtgccaagttttaaggggggaaaaccctagaccttaaattgactgagttgagttgtgtgtaaaacacttcccttcctttatacttcataaagttttggaataaattttatgcatatactgccagatttgatgttcataactttcagaggctttttttttttttaatggagactactggtctaattcactttactttgcaaaaactatcagtcccaaatctttcagtcactatgcctgtagcattaaattgaaatggtcattgggtttgagcttcaatttgcttgccatttcatggtcctacaaagagatgtttgtcccctttaaacatatgcagatatgcctgcatcttctttccaggttaactataccttattcgattgtgctgttttggagaacatcagtggaactaggtggactttgatctctacccataggtcctcaaataatttgggatctacagaaaagcaggatttagtagattattatttttaataatttacaaatatctcttaacaaagaataaccctgatagtatactattgtgagtttactaaatgattagaagtagatcctatacattattcctgtttggtttgcataaaaagatgaattttacaatggtttatacaattgtgtctatttttcat

SEQ ID NO: 168440 - DNA, 4961 bp, Homo sapiens
  Payload ID: 13155
  Gene Symbol: POU3F3
  Gene Name: POU class 3 homeobox 3
  Uniprot ID: P20264
  ENST ID: ENST00000361360
  CDS Start-End: 1-1503
atggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggccagcagccgccgccgcagagtctgctctactcgcagcccggaggcttcacggtgaacggcatgctgagcgcgccaccggggcccggcggcggcggcggcggcgcgggcggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagggccgccgccgccgccgcctccgcagccgccgtcagcaccgccgccgcccctgccgccgccgccgccgccgccgccgccgctgccgccgccgcgccgaccctgcacctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagggggcgatcatgagatctcgttcatactgtggtggtgtttcgtttttgtttttgtttttaaagaagggtgaagatgcctgacgcacgaaaactgcactcgtgaggtttttccaccctgagatgacctacacggcagcggtggacagcacctgcctcgtcttctcctctttgaaaaaaagagagagagagagtcccctttcctttcactttctccctccaaaacagctgcctaaagagatccacggaaactttatttcctgggagcgacctgagagaaaacagaggcaccaggttccatcaggggacgacaccgtgctctgggaccctgtttttcttggccatattaaagtcatttggaaacaaatcaactctgaaatgggaaggaggggggaaaaacagtctccaagaaaaaaataattatattgacagcttctgaaactaacagactgaatagcaaagccaaaagaaaagtatcctcaaagtaaccttggaaataaaaggatcgggaaggagcagagggagagggggaacgtccgctgaggagtggcgagaggccccggccgagtcgggtcgcgggcgggcgggcgaactgggagcagagcgggggcccagccagcgaggccgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaattgttagatccgttgttgatctaaaaatatttgctttatattttcattaaatgacttcttttaatattttattcagaatacttatgaactgctgcaaaacggtaatttatttttccccagatcttgtattacgtgtttttttcagacgagcacaaatcaaaatgaaatgaaaatatggacagttgttaggtaataagggtatcttttgatgtgatcatttgattgtaatttaatttgagtagtgattccgtaagagctgatcgagaaaataaatttgttagaatgaaatagtctgtgtctgatgcgtaaacactgtgtgggaagaaaagagttctttaagaaatatttttttactaatgaaaatccctaagtaatagcgttgaggaagtagagcctgctccacttaaggtacttttggaaatctagagtaaagcataggcattgctgagacagctagtattttaacatagtagtcactcctcgataatccataaattcacaatatttttctctcccttaattttagtggatgtctttagtgttttcaggtgagattgcctaaatattaacccttttcttggcgatacctgtgtttcttatcgaaagattgaacgatatcaccagtaaaaatgagccaactggctattaatggttaatacagcccctccccccaagttcagcttcttttttcttctcctgtccccctcccaacatgttcctgtctcttttctctttttctcaagactatagttgttaggagtcgcttataagtcttataaaatattttgatatcaattacttcccatcaataactatatgtaattaaatttaaattattaagctttttgggttttttccccccgtaataaaagaatatagttctaaaatcctgattatggtccacactgcataccatctgtgcaattaccaactcagacttaaggttctatatttctgtgtttttgtctctccccagtatgattctatatcttctttactggtgctgggggttttaggtcaccttttacataaaccctgcagagtggtcacattgatcaagttaatgtttcaatatttacaatgtgggaaaatgaaagtgtaatgcctcaggttgtgagtacttaagacgctaaaggctcggcttagttgagtccctatatattgtacttaaaagtatttagcagtggtagagcaacgattttatagacaaattccccccaatctcacttagctgtcactcactttttttcctccttctctcatcttcactccctctccctgtgatatcaatgcaggggttaaaaaacccggaaaactgtgagagcaacaaggcacagttatttctcccagacaggccctgtgtcactttcataaatcaaacccagccagatggccatgtattgggttgcattattttaaacaccaaatcgtactaaaaatcacaatcattttgatttgtgaaatctgaaaaaggccacatatattaaacagagagaagaaaaaaatgaagacaagaaaccacaatttacttttctttgccttcttgttccctatttctcttgctgctgtaatccctatgcccagcaaatttacaacctggagtgggggtgggggagaagttcaccattttgggggtgtctagagaggcaagcaaagaagtcctcattggaaagctgaggactggtcaggttgtttttatgtggtggatactactggcacgtgagatggaatcttgtttttcctatgggaatggtggtggttgattagacaagtaataggtctattaaaaaaatttcaggaggtatctacttagttgatttagctgacaacaaaagagctaacattagatttcacactgttttctattaaaaagcaaactttgctgattactttggaagaatccctgatttgggggtagcagagtaacttttaattggagaagctgggaaagcaaacccattttgtttcattatttgcattttataaagtgagctaatgcttgcactccattttttttaatcaaccctttcaatgtaattacaaaatgaaattcatggttgaaaaacaaaagagggcagatataactgagaggttttgtgctaaggcttatattgttacacatgtaaataatgaaaatattgttatatatcaccagatctttttaatgaatttggtcattgtgttc

SEQ ID NO: 168441 - DNA, 3878 bp, Homo sapiens
  Payload ID: 13156
  Gene Symbol: POU3F4
  Gene Name: POU class 3 homeobox 4
  Uniprot ID: P49335
  ENST ID: ENST00000373200
  CDS Start-End: 76-1161
ccccgcaccgtagatgtcaaaggctgaagctgctccctttgccacattataactagtaggggatcctcaccgaccatggccacagctgcctcgaatccctacagcattctcagttccacctccctagtccatgcggactctgcgggcatgcagcaggggagtcctttccgcaaccctcagaaacttctccaaagtgattacttgcagggagttcccagcaatgggcatcccctcgggcatcactgggtgaccagtctgagcgacgggggcccatggtcctccacactggccaccagccccctggaccagcaggacgtgaagcccgggcgcgaagacctgcaactgggtgcgatcatccatcaccgctcgccacacgtagcccaccactcaccgcacactaaccaccccaacgcctggggggccagcccggcaccgaacccgtctatcacgtcaagcggccaacccctcaacgtgtactcgcagcctggcttcaccgtgagcggcatgctggaacacgggggactcaccccacctccagctgccgcctctgcacagagcctgcacccggtgctccgagagcccccggatcacggcgaactgggctcgcaccattgccaggatcactccgacgaggagacgccaacctctgatgagttggaacagttcgccaaacaattcaaacaaagaagaatcaagttgggcttcacgcaggccgacgtggggttggcgctgggcacactgtatggtaacgtgttctcgcagaccaccatctgcaggttcgaggccttgcagctgagcttcaaaaatatgtgcaagctgaagcccctgctgaacaagtggctggaggaggcggattcgtccacagggagcccgaccagcattgacaagatcgctgcacagggccgcaagcgcaagaagcggacctccatcgaggtgagtgtcaagggcgtactggagacgcatttcctcaagtgtcccaagcctgccgcgcaggagatctcctcgctggcagacagcctccagttggagaaggaagtggtgcgtgtctggttctgtaatcgaagacaaaaagagaaaagaatgactccgccaggggatcagcagccgcatgaggtttattcgcacaccgtgaaaacagacacatcttgccatgatctctgactggaggaagcgaggaggcggccggccgcactgggagcagcgcggatttctctttctctctcactctcttcctttcattctagtattctttattatttttctctctctctcgttcgctcgctctctcgtactctctctcttttccctcctttcctttttctttcctttcccctttttctttcccttctttttccctttcctttcctttcattttctttcctttccccttcccttcccttcccttccatctcttcctttcctttcctttcttttcttttgctttcctttcctttttttcccttttctttccttttcataagaggttctaacttctgttgacaaaggaaacacatactctctcattcaggcttctcaatgctgatacacagttacattaagcagtccaagctgggatctcatattcctggctccccgggcaacagttccctttagccttttctgctgatcaatacatattgtttactcagagtaaggtttgtttggtcgctcctctctaggaagaacaaggagtgggataacgtgggggcggggtggggcgggggagggattgggaagacagatgtgtgcctctgaataacctttcagcgccttggttatagcagctgtatttcaggtgaaatttgttttacaatagactagttttgcatttttaaaaacttctatagcgtttctaaatgtctgcggtgttttactacaatctgtacacaatatttgtgagataatttgtatctaatcgaccactccatgttattattgctattattattactacttcgttgagctgatggctttttaattgcttagaaaagggaggagatgaatgggaataggcggggagagagatgcctatctactcaccgcccccccccttcccaaatctctatgaggaggagaggatacaacgaagagagttattgatgatgatattggttatattttttttccggggtggagtgcctaggaagggcagaatagggaagcctattaggtttgcaaactagtgcgaagtagcagcggcgatttcgcagctttctgccctccctcctggaagtgtggagcccgcgcaggctaccgcagcatagatcgaggtatctgagaaggattcggcggcaactctgggccaaagaggtggcctgacagtctgggagggctccgcactcaccggactccaggattcctgcgcgcagaaatccaggcccccagcctcgctagggcgaccttccgcgcgacctcacttcggccctcctagaggaaagactttgccttcacacgcgattactttcactggagatcacgacccggagacgctggcgactgggccagcgcctcccatttcggttcacctccagttcaccgccccctctgagtaagaaacccttggggaggggtggcgagggagtgggggataggcattctctgctcagtgcagaacggcaatgaaatgattggcaaaggtcacagggattctggtccatccgcgtaccacctctccccccatgtatataccgctgtctgtgtgtgggctcgtggggagctgtctcggcgtttctgataagcacagctggtggaagcccacagcgacgatccagcgagctagcgagcgcccgggaggctgggttcctgctttttaaaatataaatatatatatatttttaaatctctgtgtgtatgtgtctctgtgcgtgtgtgtgtgtgcgtgcgcgtgcaaacgtgtgtgtgtagatagctgtgtgtatcgcgttactatgtacaaaaacaaaaagtacaaaaaaaaaaaaaaacctggctaggctgtgtagagatcccaaaaatatgcagttgctgtggctttattgctagctagtatccacacaccaggtccacaggcgaacctcattcccaaggagcacacacgtgtgaggccggccaagcacccaacacccagccgccgccggccagacctggctgggggcgctgcacgccactgctggccgcctagtccggcctttaggcgcagctgctgtagacaaagcttcaaactacctaaggaccagaaagcccggcccggttgtcgaggatgcgttagtatgagttgccaggcctctggtccaccacactgtgtctccctcagctgcaggtcgaagagcatgtgttaattcaaatcccggacccttctacttttttgtcaagtctctgcattctgttggtagttaggttttagttctgggattttatttttttttcccccacactgagttcatgttttacaactgttgggagttttttgtttgtttcgattttttttctttgcagttaattgctatggttcgaacctgagttaacccaaatatttctgccgactttataactgtacagttttgtatattaaacgtttttgaagttattaatttaaagaaagatcatttagtttattcatttagtaactgatgtataataaacgctattttcattaagagttgctttttcaactattttattcaaattgcctattgcagttgccaacaattatttattttcaataaattctgcattgtgtttaaaaggaaattctttcacagataagttggatgtcaaaaagaaaacaattcgctgtaatgtttgatgtgaagttttagtcaaggggtttatattgacgcaatattttattgttgtaaaagattaaaaaggtttaaataaaacatttttccaaaaaaaaa

SEQ ID NO: 168442 - DNA, 4547 bp, Homo sapiens
  Payload ID: 13157
  Gene Symbol: POU4F1
  Gene Name: POU class 4 homeobox 1
  Uniprot ID: Q01851
  ENST ID: ENST00000377208
  CDS Start-End: 235-1494
gcggggctagagctgtcggagaagcgggaccgcgaggccggcgcgcggcgctctgcgcggtcagagggagcgcctggcagcagcaggagcagcagcagcagcccgcggcggggccgccgccagccgccgcgaccgccgcggctgcagcctccgaagggaggccgggtgagccggcgtacgcactttcccgcggactttcggagtgtttgtggatatacatgccaagccgccacgatgatgtccatgaacagcaagcagcctcactttgccatgcatcccaccctccctgagcacaagtacccgtcgctgcactccagctccgaggccatccggcgggcctgcctgcccacgccgccgctgcagagcaacctcttcgccagcctggacgagacgctgctggcgcgggccgaggcgctggcggccgtggacatcgccgtgtcccagggcaagagccatcctttcaagccggacgccacgtaccacacgatgaacagcgtgccgtgcacgtccacttccacggtgcctctggcgcaccaccaccaccaccaccaccaccaccaggcgctcgaacccggcgatctgctggaccacatctcctcgccgtcgctcgcgctcatggccggcgcgggcggcgcgggcgcggcggccggcggcggcggcgcccacgacggcccggggggcggtggcggcccgggcggcggcggcggcccgggcggcggccccgggggaggcggcggtggcggcccggggggcggcggcggcggcccgggcggcgggctcctgggcggctccgcgcaccctcacccgcatatgcacagcctgggccacctgtcgcaccccgcggcggcggccgccatgaacatgccgtccgggctgccgcaccccgggctggtggcggcggcggcgcaccacggcgcggcagcggcagcggcggcggcggcggccgggcaggtggcagcggcatcggcggcggcggccgtggtgggcgcagcgggcctggcgtccatctgcgactcggacacggacccgcgcgagctcgaggcgttcgcggagcgcttcaagcagcggcgcatcaagctgggcgtgacgcaggccgacgtgggctcggcgctggccaacctcaagatcccgggcgtgggctcactcagccagagcaccatctgcaggttcgagtcgctcacgctctcgcacaacaacatgatcgcgctcaagcccatcctgcaggcgtggctcgaggaggccgagggcgcccagcgcgagaaaatgaacaagcctgagctcttcaacggcggcgagaagaagcgcaagcggacttccatcgccgcgcccgagaagcgctccctcgaggcctacttcgccgtgcagccccggccctcgtccgagaagatcgccgccatcgccgagaaactggacctcaaaaagaacgtggtgcgggtgtggttttgcaaccagagacagaagcagaagcggatgaaattctctgccacttactgagggggctgggaggtgtcgggcgggacagaatggggagctgaggaggcatttttggggggctttcctctgcttgcctcccctcggatttggagtgtccgttatcctgcctgcatttggggagtcccttctcgctctctttcctccacccattctctgattttcctgcctttgctgtcccctagccttgaggactggggtgctgggtgtggggattggagtatagggtaggggagaagggggggagcattcgggggagtggggagtggggggaaggaaagcggagacccgagcaggggttttaaggagcaggatggttctggggtttgggtggggggagacgcgggaagggtaggaaaatggactgtttctgaccagagacacttacctaaatatcctggggaccaaggaactatgtacaaaaacaaacctaccaaccaccaaaaactagacaaataaagacaaactaaaacaaaacagaacaaaagcaaaggaaaatgctttagaaattttaactccggggagccataatctgcaacttcattttcccccatagaagagaaaaaagagcaccaccattattaccacctccccaaccctacacgcacgaactgagtcgaaaaacgaaaaccaaacgagcgagaagttgaagttctgggtatcaaagctagttgttctgtctgcgtgtttaatttttccctctctcacctccaccccatccatatcctctttatttcctccgttccaatgagaggcctatggctgctctccaatcccgggaagtgagtgggagcacagctgaaaagagagggtcagggggaggctggctgcttgcttaggtggaatccaagttttcccgtggccctgcctatactctggtggcctggtcctgttggggtgggggtctttggagagaagggcatagtctttgagctactaaaaagcagaattccggagcttcgagatatcttattctaggaaaatgaaacaattttaacaacagttttttttcctcttatgtcgaagatctagttttagacaatttcaaaataagcttttcccactcatagaactttaacttgccctttcagttttatcttttttttagagagaggtttaaactactgatttttcctgttgattcaaatagactaatggggtgaaagttattaggagagatactctctcctgttttctccactgaacgagactcatcttgctcttctaggtcccgtttcttcctctcttggaggacatgaaattatagaaatgttgagaagttcctgctttcttttgcggtaggacttggctgtgagaaaatcacctaaatcccagaaaagaggaagacagatttaaagtgcccccacccccatttgtttcaaagaggtctgcatgttgggcgaaaacagaacaactgtgtttccttttacttgttcttattattcaagagtcatttattacaggggataaatgttgggtagcaagaactttaatttgcactaccagtctcccaaatagaaaatcatgtatagtatttcatagtaataatcaggtaccttacaagctgctggtggattttaaaaaattaagatagttgaaggtggttaggtaaaatgcctgctttgtgtacaagatactctttggatctctcgtagagatggtttgttaccatcctttaatcataactaaaacattgaaaacagaacaaatgagaaaagaaaaaaaacctgccgattaacaagactgaaatcatgcatgatctgaaaggtgtggaaagaaacacaattaggtctcactctggttaggcattatttatttaattatgttgtatatcattgtttgcagggcaaacattctatgcatttgaaactgagcactaaactgggctagctttctggtagaccgttttgtggctagtgcgatttcacagtctactgcctgtttccactgaaaacatttttgtcatattcttgtattcaaagaaaaaggaaaaaagattattgtaaatattttatttaatgcacacattcacacagtggtaacagactgccagtgttcatcctgaaatgtctcacggattgatctacctgtccatgtatgtctgctgagctttctccttggttatgttttttctcttttacctttctcctcccttacttctatcagaaccaattctatgcgccaaaatacaacagggggatgtgtcccagtacacttacaaataaaacataactgaaagaagagcagttttatgatttgggtgcgtttttgtgtttatactgggccaggtcctggtagaacctttcaacaaacaaccaaacaaaaagaaaacacaaagaaatggggggagggtagggtgttgaagggggacaaaaaggggagagattgagaatgatgtatttttttgctgaatcagaattcactttcagataactcatgaaaagtggtgctctaaataaaatgaattctatattagttgcctgtgtttataaaagttattattttttaactgcagaaactcttaaaccacagcacttgatccagagtggtgaaaaccaataaataaccaggcacccaaaaaacatttaaatttagggtcagggacagaggaatttggaggtttagatgtgatattctaccctaaaaacacctagtaactgaatggcttttctttggagggtaatacattttaaaacatttagtgtgccacctactgctccacagtgactagagagcctctatttcttggtgacttgggactagatcagatgccaaatgtacaaagtttcttaagagttgagattatatcatctgaagtcatcttattttagccaaatctttttaatttcaccggcaaatctgtgaaggaaaacacttgatgttcaaaaagaatagtacattttaaaagctgcgattttaaacagttgttaatgttaaaaaaaaaaagcactagaggtatttttaaacatagaactcttccataaaaagttgatttgtttttgctgttattgacttgaaacatcatcagttttaaataaaatgcatttgtaaaaaaa

SEQ ID NO: 168443 - DNA, 3144 bp, Homo sapiens
  Payload ID: 13158
  Gene Symbol: POU4F2
  Gene Name: POU class 4 homeobox 2
  Uniprot ID: Q12837
  ENST ID: ENST00000281321
  CDS Start-End: 249-1478
agtttcgggtgccgaggtctgcagctagcggcaagcggagtcaggcatccgttcagactgacagcagaggcggcgaaggagcgcgtagccgagatcaggcgtacagagtccggaggcggcggcgggtgagctcaacttcgcacagcccttcccagctccagccccggctggcccggcacttctcggagggtcccggcagccgggaccagtgagtgcctctacggaccagcgccccggcgggcgggaagatgatgatgatgtccctgaacagcaagcaggcgtttagcatgccgcacggcggcagcctgcacgtggagcccaagtactcggcactgcacagcacctcgccgggctcctcggctcccatcgcgccctcggccagctcccccagcagctcgagcaacgctggtggtggcggcggcggcggcggcggcggcggcggcggcggaggccgaagcagcagctccagcagcagtggcagcagcggcggcgggggctcggaggctatgcggagagcctgtcttccaaccccaccgagcaatatattcggcgggctggatgagagtctgctggcccgcgccgaggctctggcagccgtggacatcgtctcccagagcaagagccaccaccaccatccaccccaccacagccccttcaaaccggacgccacctaccacactatgaataccatcccgtgcacgtcggccgcctcttcttcatcggtgcccatctcgcacccttccgcgttggcgggcacgcaccaccaccaccaccatcaccaccaccaccaccaccaaccgcaccaggcgctggagggcgagctgctggagcacctgagtcccgggctggccctgggcgctatggcgggccccgacggcgctgtggtgtccacgccggctcacgcgccgcacatggccaccatgaaccccatgcaccaagcagcgctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgccggcatttagaagactcttggcctctccagagacgcccctttcctcgtccgctcttttctctcctctcttctgcctcttttcacttttggcgactagaaacaattccagtaaatgtgaatctcgacaaatcgaggactgaagagggagcgaacgagcgaacaactgagcccaagccggtgagaatgtgaaacagtttctcaaaggaaagaataacaaaagatggtatttgtctgttgtagcaaagttgtccctttgaaccccacctcggcttcttcagaggaagtgtggagatggctgtttgcaggaaggcagacgagacagtgtttaaaaagtccacaagaatgatcaagtaagatttgtttttattcttacagacatcacccgtgttcaagtttaaaagtacactttgcaactatttttcagaaatagaaattgattcaggactaaaactttaaactagagttgatgcttaatgtgatagagacatctctaaagtattttgaattttaaaaaaagatggcagattttctgcatttacactgtatattatatatatatttttattgtggttcttacccccttttccttctctgaagtgttaatgcttaagaaaagagttgcgcctgctgtgttcactgatcttgaaagctattattagattattgcagaacaaccctctgtaaattattaatttatctctctagcaacttaattttgtgcacattctaattaattaaacttcttccgtctaaaaaaagtgggggaaatgtatagctagtaacgttcaaaaaattttgtttgatgagtttaccgaatttttacagctttcctcctatactgtgttccttttgacccatttgtatattctcacttgaatgaagattgtttttttctttgtttttactggtagtgttctgatttgtgagtcgacactcagtaatggatgtcttaatcgtgtagacctgattcactgtctgaagtattgtttacttcgttacatatttaatggggattcccacattgtccccatgacacatgagcgctctcacttacccttacacacacacacacacacacacacacctctaacagaagggaagaagcagttggaagcatgaccgatgcaccattttctagttttaggtgcatttgccacttggtgtttgcccttcagattttagatttcaccaaggtatttcagtcttccagttttcaattgctttgttggctacatgttaatatttataggaatacttcagtttttccttttggaggtttgtttgtagaaaaactaatttgaactataagaaagacagtgcactgcttgtaaattcacattgtttggaaaaattcttttggaacaaaaaattaggtacatgataactggtaccttatctactgtaaatatttcattaaaaatgatgcacacatagatatattcttacaaattttgctgtattgctgttctctttgaggctctccaaagtcttgagttctgtatatggcctggtttcttgtttttattaatagatggtttatttactatggtaatgtattaatttatttttggtgttgttcgattgtctttcattgaagagataattttaatgttttattggcaacgtatgctgctttttcattaaaatatgctattaaaattaaatggcttttaaaa

SEQ ID NO: 168444 - DNA, 1182 bp, Homo sapiens
  Payload ID: 13159
  Gene Symbol: POU4F3
  Gene Name: POU class 4 homeobox 3
  Uniprot ID: Q15319
  ENST ID: ENST00000230732
  CDS Start-End: 90-1106
cgctgagcagcgctcacttggagagcggcaagcaagctagacaagcctgattccatgtcacccgctgccaccctgccaggagcgcgaagatgatggccatgaactccaagcagcctttcggcatgcacccggtgctgcaagaacccaaattctccagtctgcactctggctccgaggccatgcgccgagtctgtctcccagccccgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggccgaggccgcctaccgagagaagaacagcaagccagagctcttcaacggcagcgaacggaagcgcaaacgcacgtccatcgcggcgccggagaagcgttcactcgaggcctatttcgctatccagccacgtccttcatctgagaagatcgcggccatcgctgagaaactggaccttaaaaagaacgtggtgagagtctggttctgcaaccagagacagaaacagaaacgaatgaagtattcggctgtccactgattgcggcagggcgcagcgtcgggagccgggagagcctagtgctcatccctcccgggttcgggggatggttatcggg

SEQ ID NO: 168445 - DNA, 1420 bp, Homo sapiens
  Payload ID: 13160
  Gene Symbol: POU5F1
  Gene Name: POU class 5 homeobox 1
  Uniprot ID: Q01860
  ENST ID: ENST00000259915
  CDS Start-End: 74-1156
agagaggggttgagtagtcccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactta

SEQ ID NO: 168446 - DNA, 1163 bp, Homo sapiens
  Payload ID: 13160
  Gene Symbol: POU5F1
  Gene Name: POU class 5 homeobox 1
  Uniprot ID: Q01860
  ENST ID: ENST00000376243
  CDS Start-End: 102-899
gtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactta

SEQ ID NO: 168447 - DNA, 1420 bp, Homo sapiens
  Payload ID: 13160
  Gene Symbol: POU5F1
  Gene Name: POU class 5 homeobox 1
  Uniprot ID: Q01860
  ENST ID: ENST00000383524
  CDS Start-End: 74-1156
agagaggggttgagtagtcccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactta

SEQ ID NO: 168448 - DNA, 1163 bp, Homo sapiens; identical to SEQ ID NO: 168446
  Payload ID: 13160
  Gene Symbol: POU5F1
  Gene Name: POU class 5 homeobox 1
  Uniprot ID: Q01860
  ENST ID: ENST00000429314
  CDS Start-End: 102-899

SEQ ID NO: 168449 - DNA, 1163 bp, Homo sapiens
  Payload ID: 13160
  Gene Symbol: POU5F1
  Gene Name: POU class 5 homeobox 1
  Uniprot ID: Q01860
  ENST ID: ENST00000412166
  CDS Start-End: 102-899
gtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacactta

SEQ ID NO: 168450 - DNA, 1420 bp, Homo sapiens
  Payload ID: 13160
  Gene Symbol: POU5F1
  Gene Name: POU class 5 homeobox 1
  Uniprot ID: Q01860
  ENST ID: ENST00000434616
  CDS Start-End: 74-1156
agagaggggttgagtagtcccttcgcaagccctcatttcaccaggcccccggcttggggcgccttccttccccatggcgggacacctggcttcagatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggtgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacactta

SEQ ID NO: 168451 - DNA, 1055 bp, Homo sapiens
  Payload ID: 13160
  Gene Symbol: POU5F1
  Gene Name: POU class 5 homeobox 1
  ENST ID: ENST00000441888
  CDS Start-End: 297-791
ggttgccgggaatctggacctgagcgagaagcacgatccccggccgcccccgctcttgcatccccctggtcctactgctgtgcttgctggcgacggttcgttccggaagtcagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactta

SEQ ID NO: 168452 - DNA, 1163 bp, Homo sapiens; identical to SEQ ID NO: 168449
  Payload ID: 13160
  Gene Symbol: POU5F1
  Gene Name: POU class 5 homeobox 1
  Uniprot ID: Q01860
  ENST ID: ENST00000451077
  CDS Start-End: 102-899

SEQ ID NO: 168453 - DNA, 1420 bp, Homo sapiens; identical to SEQ ID NO: 168447
  Payload ID: 13160
  Gene Symbol: POU5F1
  Gene Name: POU class 5 homeobox 1
  Uniprot ID: Q01860
  ENST ID: ENST00000437747
  CDS Start-End: 74-1156

SEQ ID NO: 168454 - DNA, 1420 bp, Homo sapiens; identical to SEQ ID NO: 168450
  Payload ID: 13160
  Gene Symbol: POU5F1
  Gene Name: POU class 5 homeobox 1
  Uniprot ID: Q01860
  ENST ID: ENST00000429603
  CDS Start-End: 74-1156

SEQ ID NO: 168455 - DNA, 1420 bp, Homo sapiens
  Payload ID: 13160
  Gene Symbol: POU5F1
  Gene Name: POU class 5 homeobox 1
  Uniprot ID: Q01860
  ENST ID: ENST00000454714
  CDS Start-End: 74-1156
agagaggggttgagtagtcccttcgcaagccctcatttcaccaggcccccggcttggggcgccttccttccccatggcgggacacctggcttcagattttgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacactta

SEQ ID NO: 168456 - DNA, 1420 bp, Homo sapiens; identical to SEQ ID NO: 168455
  Payload ID: 13160
  Gene Symbol: POU5F1
  Gene Name: POU class 5 homeobox 1
  Uniprot ID: Q01860
  ENST ID: ENST00000433063
  CDS Start-End: 74-1156

SEQ ID NO: 168457 - DNA, 1163 bp, Homo sapiens; identical to SEQ ID NO: 168449
  Payload ID: 13160
  Gene Symbol: POU5F1
  Gene Name: POU class 5 homeobox 1
  Uniprot ID: Q01860
  ENST ID: ENST00000433348
  CDS Start-End: 102-899

SEQ ID NO: 168458 - DNA, 1163 bp, Homo sapiens; identical to SEQ ID NO: 168449
  Payload ID: 13160
  Gene Symbol: POU5F1
  Gene Name: POU class 5 homeobox 1
  Uniprot ID: Q01860
  ENST ID: ENST00000419095
  CDS Start-End: 102-899

SEQ ID NO: 168459 - DNA, 1723 bp, Homo sapiens
  Payload ID: 13160
  Gene Symbol: POU5F1
  Gene Name: POU class 5 homeobox 1
  ENST ID: ENST00000471529
  CDS Start-End: 975-1469
ctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcgtgagccaccgcgcccagcaaagaacttctaaccttcataacctgacaggtgttctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagaggcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagata

SEQ ID NO: 168460 - DNA, 1233 bp, Homo sapiens
  Payload ID: 13160
  Gene Symbol: POU5F1
  Gene Name: POU class 5 homeobox 1
  ENST ID: ENST00000512818
  CDS Start-End: 489-983
ctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagta

SEQ ID NO: 168461 - DNA, 1084 bp, Homo sapiens
  Payload ID: 13160
  Gene Symbol: POU5F1
  Gene Name: POU class 5 homeobox 1
  ENST ID: ENST00000549294
  CDS Start-End: 2-562
catggcgggacacctggcttcagattttgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgagg

SEQ ID NO: 168462 - DNA, 1084 bp, Homo sapiens; identical to SEQ ID NO: 168461
  Payload ID: 13160
  Gene Symbol: POU5F1
  Gene Name: POU class 5 homeobox 1
  ENST ID: ENST00000548682
  CDS Start-End: 2-562

SEQ ID NO: 168463 - DNA, 1084 bp, Homo sapiens
  Payload ID: 13160
  Gene Symbol: POU5F1
  Gene Name: POU class 5 homeobox 1
  ENST ID: ENST00000548685
  CDS Start-End: 2-562
catggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgagg

SEQ ID NO: 168464 - DNA, 1084 bp, Homo sapiens
  Payload ID: 13160
  Gene Symbol: POU5F1
  Gene Name: POU class 5 homeobox 1
  ENST ID: ENST00000550521
  CDS Start-End: 2-562
catggcgggacacctggcttcagatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggtgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgagg

SEQ ID NO: 168465 - DNA, 1084 bp, Homo sapiens; identical to SEQ ID NO: 168463
  Payload ID: 13160
  Gene Symbol: POU5F1
  Gene Name: POU class 5 homeobox 1
  ENST ID: ENST00000550572
  CDS Start-End: 2-562

SEQ ID NO: 168466 - DNA, 1084 bp, Homo sapiens; identical to SEQ ID NO: 168464
  Payload ID: 13160
  Gene Symbol: POU5F1
  Gene Name: POU class 5 homeobox 1
  ENST ID: ENST00000547234
  CDS Start-End: 2-562

SEQ ID NO: 168467 - DNA, 2276 bp, Homo sapiens
  Payload ID: 13160
  Gene Symbol: POU5F1
  Gene Name: POU class 5 homeobox 1
  ENST ID: ENST00000513407
  CDS Start-End: 1532-2026
ggaaaaaaggaaagtgcacttggaagagatccaagtgggcaacttgaagaacaagtgccaaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcgtgagccaccgcgcccagcaaagaacttctaaccttcataacctgacaggtgttctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagaggcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttggtgggttcccctctgcagattctgaccgcatctcccctctaaggagtatccctgaacctagtggggaggggcaggggcagactaccctcacccatgaagaggagtagggagagggagaagatgctttgagctccctctgggaagaggtggtaagcttggatctcagggtcacaagggccctgcgtgctccctcactttgcttctcttttgactggcctcccccagggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagta

SEQ ID NO: 168468 - DNA, 1236 bp, Homo sapiens
  Payload ID: 13160
  Gene Symbol: POU5F1
  Gene Name: POU class 5 homeobox 1
  ENST ID: ENST00000606567
  CDS Start-End: 411-983
ctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagat

SEQ ID NO: 168469 - DNA, 1084 bp, Homo sapiens
  Payload ID: 13160
  Gene Symbol: POU5F1
  Gene Name: POU class 5 homeobox 1
  ENST ID: ENST00000619340
  CDS Start-End: 2-562
catggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgagg

SEQ ID NO: 168470 - DNA, 1578 bp, Homo sapiens
  Payload ID: 13160
  Gene Symbol: POU5F1
  Gene Name: POU class 5 homeobox 1
  ENST ID: ENST00000620031
  CDS Start-End: 743-1315
ggaaaaaaggaaagtgcacttggaagagatccaagtgggcaacttgaagaacaagtgccaaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactt

SEQ ID NO: 168471 - DNA, 5360 bp, Homo sapiens
  Payload ID: 13161
  Gene Symbol: POU5F1B
  Gene Name: POU class 5 homeobox 1B
  Uniprot ID: Q06416
  ENST ID: ENST00000465342
  CDS Start-End: 1158-2237
aactggcagcatggcatgatggaaatggaatagaatcaggaattgttttgtacctgtgtgtgtgtgactttggtgttctgactcagacacatatttgagaggtagagaggggagaagagggttgccacattatgtaacagaaaggagcccactgcttaaacacttaccttgtgccagacattgcactaggactttattacctgcaacccatcctgcaaaactgtgaagatttgatatgatcattctcattttatggttgagaaacaagggttaaggacattaaaaatttactcaatgtttaaacatttgcctgtcttattctaaagccccttctcttttcacaatccctttaagaaatggacatccaatatttgagtggcagaggcaaaaacatggcctaccagaaccattatgatagctttacaatatgcccaccaattatttgatagtcctcctgccaaatggtgaaggctaattaccctcctacagaatgtgactcacttctaatgaataaaatatggcacaagtaaaagtgtgcgatttcagagactaggtcataaagaacgcagtggcttcttccctgctctctctttcttaggtcattctctctgggtgaatccagctgacatgttgtgaggacactcaagcagctttatggaaaagcccacatggtgagcaactgaggcctcctaccaacagccaacaagaaaccggggcctttgccaacagccaagaaataagaatcagaaagaaggacacaccattccatagcacagaacacaagtagatggctcccatgaagaatctagcatcatggtatggcagaagcagaatggactcaggaatcatggtgcctacactggaatttcagatcggccactgacacaatggacacattattcaacatttccaaatcttggcattcttatccacaaagtgaagataataattgtcaattcacaggtgattatgatttaaagagattacttttgaagagttcctaacacattcagtcaacatttaatgatgcttcaggcactgtgttcattgctagtgagcgtatgacacacacagccatacggtcacagagctttcaatgaaaagtaacataattgctcatttcaccaggcccccggcttggggcgccttccttccccatggcgggacacctggcttcggatttcgccttctcgccccctccaggcggtgggggtgatgggccatggggggcggagccgggctgggttgatcctctgacctggctaagcttccaaggccctcctggagggccaggaatcgggccgggggttgggccaggctctgaggtgtgggggattcccccttgccccccgccgtatgagttatgtggggggatggcgtactgtgggcctcaggttggagtggggctagtgccccaaggcggcttggagacctctcagcctgagagcgaagcaggagtcggggtggagagcaactccaatggggcctccccggaaccctgcaccgtcccccctggtgccgtgaagctggagaaggagaagctagagcaaaacccggagaagtcccaggacatcaaagctctgcagaaagaactcgagcaatttgccaagctcctgaagcagaagaggatcaccctgggatatacacaggccgatgtggggctcatcctgggggttctatttgggaaggtgttcagccaaaagaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcatgcaggcccgaaagagaaagcgaaccagtatcgagaaccgagtgagaggcaacctggagaatttgttcctgcagtgcccgaaacccacactgcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctccggccccagggccccattttggtaccccaggctatgggagccctcacttcactgcactgtactcctcagtccctttccctgagggggaagtctttcccccagtctccgtcatcactctgggctctcccatgcattcaaactgaggtgcctgcccttctaggaatggggaacaggggaggggaggagctagggaaagagaacctggagtttgtggcagggcttttgggattaagttcttcattcactaaggaaggaattgggaacactaagggtgggggcaggggagtttggggcaactggttggagggaaggtgaagttcaatgatgctcttgattttaatcccacatcatgtatcacttttttcttaaataaagaagcctgggacacagtaaaaaaaaaaaaaaaagaaagaaaagaaaagtaacataattgagtaataattttttaagtgtggtaaaatgtgtggcacgtagtaggtattcaataaatacttgcttttttcctcctttttaccttttcctagagtgctacttgatggtagctgtagtttttcttcaagacatcctatttgtcctgatacaaaacctcttttgaccgctaacggcatagttcggccctcaccattccctcacatattccacaaaaatgtgagcattaaccattccccatgatacagataattcattttttaatttaattttttaaaattttatttatttacttatttattttgagaccaggttatgagactggctaatttttgtatttttggtggagatggggttttgccatattgtctaggctggtctcaaactcctgagctcaagggatcctcctgcctgggcctcccaaagtactgggattacaggcatgagccattgcacctggcccggataattttttttctttttttgaggtagtgccttcctttatagctcaggctggagtgcagtggtgtgatctcggctcactgcaacctctgcctcccaggttcaagtaattctcctgcctcaacctcctgagtagctgggattacaggcgcccactaccacgcccggctaatttttgtatttttagtagagatggggtttcaccatgttggccaggctggtctcgaactcttgacctcaggtgatctgcctgccttggcctcccaaagtattgggattgtaggcgtgaaccaccacgcccggccctgaaaattcatttttaaaagaacatcatatctaccttaaatgcattaagatttcacattagactcattattcatagtgaacattaggaacttaagtccactcagtaataatgcacctattcatgactcttgattcaaagatgtgcacctatttaccctggaccagctccttggaaggacatgaaatagagggtaataatcacatctttccaaatttgctatgaaactgcatcgccaaaaactgagactcattttccgattgatgaatcaaatgacaacaaaatctccagggcattctgaaacccaacagggattaatgattaggcataccagtggtagttaggagacttgcccaaatttccagttttctgcagatggcatctaagttagaagactgtcataaatttattcatggcttggctttctgctatttgctcattggtgacacttttatatacaatggtgtttctatggctaggaaatcccagtggagatcaagaaacctgggttctacaaactaatggggtgacctttgattagtcctaactcccttcctaagcctcagtttctttagacatgaaatgaaagcaatggattacattgccttagactttttcctagatcgaaaatgtgataattgtgcctttccaacaataattgataccactagtgaacattctttcttaagcacatctattaaggacttcatttatattatttttctaatctttaagcaaactctgagataagtgactatgatgtttattccataggtgcaaaagatttgtcaagtaactctccaaagtaaaagagagggctggagtttagactcatgactgttctgctctaacccaagtgattctggatcccagactccccaaatgacaagttattccagaaatactcagaaaaaggagggtgccgtatgtcgcacatggaaaaatagaaaaagtaacagaatccagccaaaggattcccagaaattgaggctcttctgttcttggcatttgcatctttggatgtgtgttttttacattgctctatgcaaaaggtatgtttcaatgtgattttttttttctcctcccatcctaccactgaggaatcacagggaatagactcgacacctgtgaactcaatttaccctagaaaaatgtttcagtcacacttaaaataaaaagggcatcaattagaataagaaggacactttgttgcctaggaggactgaacttttttggacctggggcaccttatcagcttcatttttagctctagtataatcaaaaggtcaggatctccactggaccttagaaattttttatttttcgataagattttctgaatgcctgccatgtgtgaagggaaatgcctggacttctatgcatatgtatttcattgtctccccacatctacccaggaagacaggcacagtgagccttgcatgttgtagataaggaagctaagtctcaaagacagagaaggaatttctcaaggtcacactgtaagtaaaaggcaaaggagggattagaaccctggatcctctttattacaccaagcctgcctcacaaggatgccaatctctcatcacttactgggaaagacccactcctcccattcatgataaggtaatgctatccaataaaaaccccaaagcaggcataaaatatgaagtagcgaaactcaggcaggcagaaagcagagtggtttagacatggctgctgtctgcagcagggagaagttcctggcaacatgaccctgaaaataacaatgagtgactgaagctaagaaggaagaatcttccaaggactctgaaactagatattttctcaagccccacctatggacaaacacaaatcatggagaaataaagatgccagtctccaggaagcaccagagttaaattcattctggaatttaactcctggcattaacagttagctgggagattaaaacaaaccaacacacaaacacaaaaaaataatcagtggaaaaaagttaaaaaaaatcaatggacagtggtttcatagcagatggcaaagaggaatattaaaagctgtattttatttggaactc

SEQ ID NO: 168472 - DNA, 2474 bp, Homo sapiens
  Payload ID: 13162
  Gene Symbol: POU6F1
  Gene Name: POU class 6 homeobox 1
  Uniprot ID: Q14863
  ENST ID: ENST00000333640
  CDS Start-End: 483-1388
aggatcaagggaatcgtggctgcctgccccactgagcccactgccccaaccccctctccttcttgtgccagatcccttgggattggagccgctgtgagcagtggctaggcatttgagcacctctgtctctgccttgctccatagcagctgctgtgctgaacaccgctcttccggcaccggtacaagctgccgcaccagtacaggcctcctcgacggcccaaccccggccaccagcccagccccagacgctgttccagacccagccgctgctgcagaccacacctgccatcctcccgcagcccactgctgccaccgctgctgcccctacccccaagccagtggacacccccccacagatcaccgtccagcctgcaggcttcgcatttagcccaggaatcatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagcccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttga

SEQ ID NO: 168473 - DNA, 5157 bp, Homo sapiens
  Payload ID: 13162
  Gene Symbol: POU6F1
  Gene Name: POU class 6 homeobox 1
  Uniprot ID: Q14863
  ENST ID: ENST00000389243
  CDS Start-End: 941-1846
aatcggtggccgccagacacccgcggcgaaggcggctcgggctcgggctccggatgtgctaggtgtgggccggcccccacccgaccctgacaagtgaccatggatcctggagccgggtcagagacatctctgactgtcaatgagcaggtcatcgtgatgtcaggtcatgagaccatccgagtgctggaagtcggagtggatgcccaactccctgctgaggaagagagcaaaggactggagggtgtggccgccgagggctcccagagcggagaccctgctgaagccagtcaagctgctggtgaagctgggccagacaacctgggctcctctgcagaggcaactgtgaagtcacccccggggatccctccgagccctgccactgccattgccaccttcagccaagccccaagccagcctcaggcatcgcagaccctgacgccactggctgtacaagctgccccccagtattgcaggtcaagtggctggtcagcaggggctggccgtgtggacaattcctacagcaactgtggctgccctcccaggactgaccgctgcttctcctacggggggagtgttcaagccacctttagccggtctccaagcagctgctgtgctgaacaccgctcttccggcaccggtacaagctgccgcaccagtacaggcctcctcgacggcccaaccccggccaccagcccagccccagacgctgttccagacccagccgctgctgcagaccacacctgccatcctcccgcagcccactgctgccaccgctgctgcccctacccccaagccagtggacacccccccacagatcaccgtccagcctgcaggcttcgcatttagcccaggaatcatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagcccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttgacttaactctaattttctttgtaactttaagccttggatacgggaggagaaatctcattttgtcgagtctcagaccatgtctgtgtgtaagcaatccccacagtgtcctctgagccaaggacacccccagatcagattgagttttgcttctagacggggtagctatggtaccttgggggttagctctcatccaagctgttaagtgagtttccagcctcactgtggctggaaagcccctaaaattcagtatgtaactccaggaagtcaggagagaactgagatttgcctagatgaccacaggcttgcggtgtagattatccctaaagggccccaagtcacgggggtcaaccacccctgtcttcagtactcttatccttacagaggctggtctctaacagctgcctccagtggacctcccatgatccaccctgagggaaggaccgtcagctggggacacatcaccacctctgtcagtcactggtgcagagccacctcctagcctagcttcctctggtgtcctgtttcctttcccacttactgttggtgcctcccaggccctgcagtgccagcgtggccaccctcttggtagcctggccagtaagaggaggacagttgtgtgctgaattagcacacgcacgtgcagcgcgcacagacgcgcgcacacacacacacatacacgctctgctgcatttggacaaaccatgcctgccagagtgtagcagaggtgaggaagcaggtgggcagcttgcctgacccagcttttcaggagagcgtgtctccaacagagagtctccacactctagttcagggttatcgacctgcctcaatgagatgacagactcatttgggaggggtgttgcaaacaagttttcagtgagaatagttaagttccagagcttgtaaaggattcagtgactgacacttcagtaaattaggccaggcacattggcttatgcctgtaattccaacactttggaaggccgaggtgggcggatcatttgaggtctggagttcgagaccagcctgaccaacatggtgaaaccccgtctctactaaaaatacaaaaattagccaggtgtggtagtgcacatctgtaatcccagctacttgggaggtggaggcaggagaattgcttgaaccctggaggttgcaatgagctgagatcacactacttcactccagcctgggtgacagagcaagactcggtctcaaacaaacaaaaacttatggcgatgcaggttttcatgctcagacgcttgcattcaggtatgctttcttttttgagagagacaaatgggtcacagctggcaccctgggaatagcacataatccagggtgtgtctgtggtggtggacgtgcaggggaacaccatctgtcctgtgtcatgatgggaaaacaatcatgaaccactggtctaaattaggcctggccatgctttctcagcccctccctcatttaaatttgtcttcccaaagctgagctaaaactaaaccatttctcctctgctggaatgatggattggtcattcagaggaacaataccaggggtgggaggtttgcaggctgagttccccaggcatgggggtgcagggtgtccctgaggtttacccaaagcacagctcgctggcctgtgacctctgcccttcctcccacagtgtaagaccccccaggaagcagctggggcctgaacctctcacctaggaggtaggtttattttattttttgttagcatcaggctctgaaggagttggtatacattttgttttgaaaacatcttctggacttacaccagagcttagtgtcgtctttactatggaaagagaggagaatggacagaaatggtttaactgtgtggagttttgtttgttttgttttaaatggaagaaagaccaaaactttcctggtggatcagctagggcctttgaccctgcattaccacggcattttatccaggtgaagtccagggaaagaactcagccaaatggactaaggaacacacgagtttggaatgcgagactctgacatttttgtgttcttggaaatccaattaccttcccatgcccagatttccttcctgcctcttggaccaggctctggcactgaggttctcactgttcccaacacagacaaagcttcctgagggctggaggggcagcaaggggagaggagaatggggaagaagcgcttgatgtagttgtgtggaataaacagtattttttcttttgta

SEQ ID NO: 168474 - DNA, 207 bp, Homo sapiens
  Payload ID: 13162
  Gene Symbol: POU6F1
  Gene Name: POU class 6 homeobox 1
  ENST ID: ENST00000547855
  CDS Start-End: 120-207
atttagcccaggaatcgctcttcctccacccacagatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtgg

SEQ ID NO: 168475 - DNA, 2184 bp, Homo sapiens
  Payload ID: 13162
  Gene Symbol: POU6F1
  Gene Name: POU class 6 homeobox 1
  Uniprot ID: Q14863
  ENST ID: ENST00000550824
  CDS Start-End: 193-1098
gaagcccacattcacatctacccaccccaatgccctctgtcctcttccctctgcccggggttcttctcaccccttggcttctgagcaaggctcttcctccacccacagatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagcccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttga

SEQ ID NO: 168476 - DNA, 2335 bp, Homo sapiens
  Payload ID: 13163
  Gene Symbol: POU6F2
  Gene Name: POU class 6 homeobox 2
  Uniprot ID: P78424
  ENST ID: ENST00000403058
  CDS Start-End: 155-2230
gatggattgctatctctcagcgcagcaggacacggggaccatgcaagctgtaattggtcaggcatgaactctcttgggttgtgttaccctgtttgctgtttactgtcaagatgctgaaagaatgttcttataatgatccaagaggaagtggcaaatgagtgctcttcttcaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccagaaccagaaccaaccatctccaacccagcagagctccagccccccgcagaaacctagtcagtctccaggacatggcctgccttcaccgctcacgccacccaatcctctacagctggttaataatccactagcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagctccaccaaccctcccagacgtcagtgggtcaagcagcctcccaaggcaaccttctgcacctggctcacagccaagcatccatgtctcaaagtcccgtccggcaggcttcctcttcttcctcctcatcctcctcttcttcagctttgagcgtgggccagttagtcagcaatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcagacacaccatcctgagaagccactttttcctaccacaggaagcccaagagaacactatagctagcagtctgacagccaaactgaaccctggccttttgtatcctgccaggtttgaaaagctggacatcacccctaaaagtgcccagaagatcaagccggtgcttgagcggtggatggctgaggctgaggcccgccatcgagcaggtatgcagaacctgaccgagtttatcgggagtgaaccatccaaaaagcgcaagcggcgcacctccttcacaccccaggcccttgagatcctcaatgcccactttgagaagaacacacacccttctgggcaggaaatgaccgaaattgctgagaagctgaactatgaccgagaagtagttagagtttggttctgcaataagaggcaagccctgaagaacacaattaaacgcttaaaacagcacgagccggccacggcagtccctttggagcccttaacagactctctggaagaaaactcctaaagagatgcccacccataatcagaagcaaaattcacagaaactaaactccacccttgggactccacaacaacaacaacaacaaaatttaatttaatttaaaaatag

SEQ ID NO: 168477 - DNA, 1028 bp, Homo sapiens
  Payload ID: 13163
  Gene Symbol: POU6F2
  Gene Name: POU class 6 homeobox 2
  ENST ID: ENST00000416452
  CDS Start-End: 1-429
gcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcagacacaccatcctgagaagccactttttcctaccacaggaagcccaagagaacactatagctagcagtctgacagccaaactgaaccctggccttttgtatcctgccaggtttgaaaagctggacatcacccctaaaagtgcccagaagatcaagccggtgcttgagcggtggatggctgaggctgaggcccgccatcgagcaggtatgcagaacctgaccgagtttatcgggagtgaaccatccaaaaagcgcaagcggcgcacctccttcacaccccaggcccttgagatcctcaatgcccactttgagaagaacacacacccttctgggcaggaaatgaccgaaattgctgagaagctgaactatgaccgagaagtagttagagtttggttctgcaataagaggcaagccctgaagaacacaattaaacgcttaaaacagcacgagccggccacggcagtccctttggagcccttaacagactctctggaagaaaactcctaaagagatgcccacccataatcagaa

SEQ ID NO: 168478 - DNA, 570 bp, Homo sapiens
  Payload ID: 13163
  Gene Symbol: POU6F2
  Gene Name: POU class 6 homeobox 2
  ENST ID: ENST00000451021
  CDS Start-End: 137-570
tatactggtaggaggagagtgtgtatgtgtttgcatgcaagagtaggagagaggggggaggcagatagagaagaaaatgacgtgcacctgaagtgttctcggcaggagcagttctagaatactttattacatatctatggagacaatggcatggactgatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagc

SEQ ID NO: 168479 - DNA, 5925 bp, Homo sapiens
  Payload ID: 13163
  Gene Symbol: POU6F2
  Gene Name: POU class 6 homeobox 2
  Uniprot ID: P78424
  ENST ID: ENST00000518318
  CDS Start-End: 43-2010
gctgaaagaatgttcttataatgatccaagaggaagtggcaaatgagtgctcttcttcaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccagaaccagaaccaaccatctccaacccagcagagctccagccccccgcagaaacctagtcagtctccaggacatggcctgccttcaccgctcacgccacccaatcctctacagctggttaataatccactagcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagctccaccaaccctcccagacgtcagtgggtcaagcagcctcccaaggcaaccttctgcacctggctcacagccaagcatccatgtctcaaagtcccgtccggcaggcttcctcttcttcctcctcatcctcctcttcttcagctttgagcgtgggccagttagtcagcaatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcaggtttgaaaagctggacatcacccctaaaagtgcccagaagatcaagccggtgcttgagcggtggatggctgaggctgaggcccgccatcgagcaggtatgcagaacctgaccgagtttatcgggagtgaaccatccaaaaagcgcaagcggcgcacctccttcacaccccaggcccttgagatcctcaatgcccactttgagaagaacacacacccttctgggcaggaaatgaccgaaattgctgagaagctgaactatgaccgagaagtagttagagtttggttctgcaataagaggcaagccctgaagaacacaattaaacgcttaaaacagcacgagccggccacggcagtccctttggagcccttaacagactctctggaagaaaactcctaaagagatgcccacccataatcagaagcaaaattcacagaaactaaactccacccttgggactccacaacaacaacaacaacaaaatttaatttaatttaaaaatagccccagtcgtcatcacccttgtaagtaaatgactaagaaaactaccaagtggacagaatggtttctacatgtccgttggttttccaaaaaggaaagaagaaaatttttagaaaatttttaaacaaggaatacaccacactgaaggtgtgtgtggtaggatagttcccttcccccacctgtctcccccaaagccagttttttaatggacttaaagcaaaccaaataaccacgtacttttttctgtatattatgaaaatgtgaacacattttaaggaaaaagaaaaaaaaaaactaaaccaaaaaccaacaacgaaggaacaaaaactttgatctgttcaaagcgaatacaagcctgccacctggaggaaggactgcaccccttcaggtactaagtgctgattcactatgaaacctattaaccaaagtcagaaacatggcattgcaacgcgatcgttcgtctacgcttctccgcacgtaaagttgtgttacgaatttttacatttgtactaacagaacaataggaagcctgatttctcccatctttcccatctactgtctccacccatggggtgggtaccattgttgaagccattctgtgaggctcactattgggtttttttgtgggggtggtagggagggtggtcttttttctttgtctttctttttgacgggagggcatcctggatcgtgtgccaaagcatttgttgcttttttctcactatgacttgtgggtttgagaaaagaaaatggagctcgcatttctctcttttcctccatttctccatctccctcgcgcgtggctcctggggtctgctggaaggccacagaagtggggagaagcagtgtcttttccactcagatcctagtgaaatgcaggagagactccaaaataactagggctttgctcgatgaactgtcaacactggcataagctgtaattgtgctcactgtccacaccagagcttgggatttttctcagtctgttggccacgtacatggagagctgaccaaaactaattttgtaatataaacataagctgcacatttggttcaatacttacatctatgttatgcttctgtgcaaagcaatttctctcagaagtctgatagccaaagaaatgtctcaagatttcagtcaaatacacacatgacatgcacacacccataaacacacacacaaagaaacaggctaaaaagaaagtgatagcaactggatcattaaaggccatcgtgtatcctgttaatctcatcttttctgctacttctttcattccaatagcgatggcagacttttttcagggggaataattactcttcgggatatataaatggagcagaaaggtggcgggcaaatttaaacaactggaattgggggccaggttcttcaggggaaaggaagtttgaagaagctttcaccaaaagaaaaaaatatagaaggggcttatctaacaatcagaatagcctgcaatatgagaactagaggattatttcctttaaaaaaaataacttaaaagatctgtgggccacaataacctaataagcaaggacatgttgggatgtgaggacggctgtgcaggtgagcacttggcagctgccactggtgttttcacccaggtacaggcagacggtgttccattaaaggagcaggcaaaagagagctgtcaatttgcttgctgttgaaatgtacatatttatgcataatttataatcatgctaatgtattatctagaagtaagttgtgaaagaaaaaagagaaacccaatctcaagttgcccaactgattagaaatgccatctccttcccctaatacactccctctccctggggagtttgagtttcttctgttggctcctttgctgtttgtgtaaatgctacagtataattgtcccctccaatgattcatgcagcaatcaagagactaccagcaaggaaactctaaaaggaatcctggaagtggaacaagtcactcgtaaaggtgtttccattttaccagtcaatgctaactggaccacagctaacttgatcttcaatgccaacatcacagagcccctttcgccacctcaaaaactgcacaaacatggacaacccagaaacccaaaactttattgattaaaacagattttggattctcctaggacctgctccaaattccatcaagaaaagctccctgcgaagagaagttaacaagataacatatgatggatgctaaatatttaaatatatgccggcagcggttacataaggcctgctcagttctgagatctataattgggagggtctaactaggacagggaaaatataaaataaaagtaatcttccagagtggaacaaaaaagaaatatattcatccgacagtcgtaacaccattcatgtgcagtgatttttttatagttttataattttgtattgttttataaattatttataaggtgttgtaatgcttcttatattaattttttacagataaattttttgctacaaggcataaaaaggtgcctgaaccgattcttaggaatataaattatactgtgtaactcataagtctttgggaccacacctaatgcttaattttatgatgacatttctcatgtctacttgtaaacaacttcatatgccaatggcgtttaagtgtcttttatgtttccatgaactgaaggttaaggttgccacccacaaaaaataaaagccactttgggcatatgtgattgtatttcaagcttcagtatttttctcacataatttttaattattgttatctgcattttcattacttcatgaaaaaatgacagtggatattacattttacacttgtttatagattttctttctttttcaaccaagaaaatattttgaacaattgaaacttttaattgcatttgcaaggttttggcttctttatgttgtcatcacacagatgcacacacacatacacatacaacacaaaagagagaacaaaaaagcaaaaggagctaggaaaaaaacaaaacaaaacaagtagaggtgtatcaaagaactcaagctataaccaaaaagaaatcgtaaaatgcctttgctcgtttctctacgctggaccaaagctcaatatttgtaggtatatgcacattgtatagatatggctaaatgttgctgacaatctcgcaatactaaactgttcctattttaagaaaaaaaaaagaaatacaaactgttcatcaatgttttacctcagcactctacttgtacccagttaatgaccaagcttaaaaaaaaattgagataaaggaaattgattttcatttcaatgtttgactgtaaaatctgtttggataacattttgtaatgagctttttgtcatgtgatttgcttgtcttcaacttgaaattatgtgaggcacatttgtttatttgttgttaagaaagtgatttttttttttttttgtcctatgtgctgtgatctagactggtcaccggggtcacttatgaggcaccacaaagagatctgcttctccgtgcccggagcaggcagcaggagggagggcaggaaacaggactgggttgctttggaaaaatcatcatgacaagaagttgacatgatagacttgtgaccaagaagccaaactgaatatttaaaagctccttacttgctctgacattgaaaccaaagctgattttatctgcacaggttgcttaatatttaaaaaaaaaaaaaactgtacttaatctagagcaatatctgtatggtcagtaaagctgcactttgtgtatttcttaacagcttcagatctgtcacttttaatttgtaccataaaaaataaataattgtttgacatga

SEQ ID NO: 168480 - DNA, 2403 bp, Homo sapiens
  Payload ID: 13163
  Gene Symbol: POU6F2
  Gene Name: POU class 6 homeobox 2
  ENST ID: ENST00000559001
  CDS Start-End: 102-2012
agagagagaagagagagggagagggagagagaggacacgcactctaaatctgccactttttttttcctccccttcactcttttcgcccatcctaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccagaaccagaaccaaccatctccaacccagcagagctccagccccccgcagaaacctagtcagtctccaggacatggcctgccttcaccgctcacgccacccaatcctctacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagctccaccaaccctcccagacgtcagtgggtcaagcagcctcccaaggcaaccttctgcacctggctcacagccaagcatccatgtctcaaagtcccgtccggcaggcttcctcttcttcctcctcatcctcctcttcttcagctttgagcgtgggccagttagtcagcaatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcagacacaccatcctgagaagccactttttcctaccacaggaagcccaagagaacactatagctagcagtctgacagccaaactgaaccctggccttttgtatcctgccaggtttgaaaagctggacatcacccctaaaagtgcccagaagatcaagccggtgcttgagcggtggatggctgaggctgaggcccgccatcgagcaggtatgcagaacctgaccgagtttatcgggagtgaaccatccaaaaagcgcaagcggcgcacctccttcacaccccaggcccttgagatcctcaatgcccactttgagaagaacacacacccttctgggcaggaaatgaccgaaattgctgagaagctgaactatgaccgagaagtagttagagtttggttctgcaataagaggcaagccctgaagaacacaattaaacgcttaaaacagcacgagccggccacggcagtccctttggagcccttaacagactctctggaagaaaactcctaaagagatgcccacccataatcagaagcaaaattcacagaaactaaactccacccttgggactccacaacaacaacaacaacaaaatttaatttaatttaaaaatagccccagtcgtcatcacccttgtaagtaaatgactaagaaaactaccaagtggacagaatggtttctacatgtccgttggttttccaaaaaggaaagaagaaaatttttagaaaatttttaaacaaggaatacaccacactgaaggtgtgtgtggtaggatagttcccttcccccacctgtctcccccaaagccagttttttaatggacttaaagcaaaccaaataaccacgtacttttttctgtatattatgaaaatgtgaacacattttaaggaaaaagaaaaaa

SEQ ID NO: 168481 - DNA, 1485 bp, Homo sapiens
  Payload ID: 13163
  Gene Symbol: POU6F2
  Gene Name: POU class 6 homeobox 2
  ENST ID: ENST00000524147
  CDS Start-End: 249-1485
agagatccagagaaatcttgagaattgtgtgtctcttttcccttctgcctgcctcccccatctaccccaagtttcaagcgctccaaatcccagcaacaagacccagtaaacaaaatgcaaatctatcactagcaaattcaagctgacaatactgtgaatcgaccgcattgattacattgattatatttcaaatatttacaatatggtgagacaagtctaatttcttttctaaagagttcaaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccagaaccagaaccaaccatctccaacccagcagagctccagccccccgcagaaacctagtcagtctccaggacatggcctgccttcaccgctcacgccacccaatcctctacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagctccaccaaccctcccagacgtcagtgggtcaagcagcctcccaaggcaaccttctgcacctggctcacagccaagcatccatgtctcaaagtcccgtccggcaggcttcctcttcttcctcctcatcctcctcttcttcagctttgagcgtgggccagttagtcagca

SEQ ID NO: 168482 - DNA, 1290 bp, Homo sapiens
  Payload ID: 13163
  Gene Symbol: POU6F2
  Gene Name: POU class 6 homeobox 2
  ENST ID: ENST00000520104
  CDS Start-End: 82-1290
gcgatttttgttttctttttctttaatgctctgggtgtacgatgctctaggtatccgaattattgaacacagtttgatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccagaaccagaaccaaccatctccaacccagcagagctccagccccccgcagaaacctagtcagtctccaggacatggcctgccttcaccgctcacgccacccaatcctctacagctggttaataatccactagcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcag

SEQ ID NO: 168483 - DNA, 1330 bp, Homo sapiens
  Payload ID: 13164
  Gene Symbol: POU5F2
  Gene Name: POU domain class 5, transcription factor 2
  Uniprot ID: Q8N7G0
  ENST ID: ENST00000510627
  CDS Start-End: 75-1061
gggggccggtggctgttctgaagcctcgagggccatcagttcctaccagagccgctgcgggtgccattccacccatggccggacacaggccctcaaaccacttctgcccccttccaggcagtggtgggggcggccccagagggccgatgcccctgcgggttgacactctgacctggttgagcacccaggcggcccctggcagggtgatggtctggccggcagtcaggccagggatctgcccaggccctgacgtgtggaggattcccctgggtcccctgccacacgaattccggggctggatagcaccctgcaggccccgtcttggagctagtgaggcaggggactggttgcgacgcccctccgaaggcgccctcccggggccctacattgccctgcggagcattccgaagttgccgccgccagaggacatctcgggcatactgaaagagttgcagcaattggccaaggagttgaggcagaagaggttgagcctagggtactcgcaggccgatgtggggatcgctgtgggagctctgtttgggaaggtgcttagccagacgaccatctgccgcttcgaggcccagcagctaagcgtcgccaacatgtggaagctgcgaccactgctgaaaaagtggctgaaggaagtggaagcagagaaccttctgggcttatgcaaaatggagatgatcctgcaacagtctgggaagtggagacgggcaagcagagagcgacgaatcggaaacagcctggagaaattcttccagcggtgccctaagcccacaccccagcaaatcagccacattgctgggtgcctccagctgcagaaggatgtggttcgagtttggttctataaccgcagcaagatgggcagtcgaccaaccaatgatgcttccccacgggagattgtggggacagccgggcctccttgcccaggagcaccagtgtgctttcacctgggactggggctcccagtggatatcccccactatacacgtctctactctgcaggggtagcccactcctctgccccagccaccactctgggcctcctcagattttagggctgaggggcttgcccttcacggcacggttggagaggggagaagaagggaaaacccaggaaatgtccctagggttcatttgagggcttttagtattaatttctcattcactgtctaaagaagttaaggatacatagtagggaatgggggtgggaattgttcaagaaaaacctgggagagaagatgaagtttattgcagttttgtgttttccctttgtttttccctagcattggtttaaaggtacattacagtatatagatggtttcga

SEQ ID NO: 168484 - DNA, 2516 bp, Homo sapiens
  Payload ID: 13165
  Gene Symbol: PATZ1
  Gene Name: POZ (BTB) and AT hook containing zinc finger 1
  Uniprot ID: Q9HBE1
  ENST ID: ENST00000215919
  CDS Start-End: 175-1788
agtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaaca

SEQ ID NO: 168485 - DNA, 3781 bp, Homo sapiens
  Payload ID: 13165
  Gene Symbol: PATZ1
  Gene Name: POZ (BTB) and AT hook containing zinc finger 1
  Uniprot ID: Q9HBE1
  ENST ID: ENST00000266269
  CDS Start-End: 631-2694
gctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 168486 - DNA, 3638 bp, Homo sapiens
  Payload ID: 13165
  Gene Symbol: PATZ1
  Gene Name: POZ (BTB) and AT hook containing zinc finger 1
  Uniprot ID: Q9HBE1
  ENST ID: ENST00000351933
  CDS Start-End: 631-2556
gctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacatta

SEQ ID NO: 168487 - DNA, 3711 bp, Homo sapiens
  Payload ID: 13165
  Gene Symbol: PATZ1
  Gene Name: POZ (BTB) and AT hook containing zinc finger 1
  Uniprot ID: Q9HBE1
  ENST ID: ENST00000405309
  CDS Start-End: 631-2244
gctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacatta

SEQ ID NO: 168488 - DNA, 2385 bp, Homo sapiens
  Payload ID: 13166
  Gene Symbol: PPAN-P2RY11
  Gene Name: PPAN-P2RY11 readthrough
  ENST ID: ENST00000393796
  CDS Start-End: 1-2385
atgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgccctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatga

SEQ ID NO: 168489 - DNA, 2661 bp, Homo sapiens
  Payload ID: 13166
  Gene Symbol: PPAN-P2RY11
  Gene Name: PPAN-P2RY11 readthrough
  ENST ID: ENST00000428358
  CDS Start-End: 173-1735
gtgtctccatagcaaccgctccatctgattgcccctccccgctcccagaggccacctagtgcgcaggcccgcctgatgtcgtcccacgccgtgccggctctcaggcgccggaagtgagctgcgcagcgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgccctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatgatgtggcctagcggaagctgcctcctcaccctaggtgttgctg

SEQ ID NO: 168490 - DNA, 3035 bp, Homo sapiens
  Payload ID: 13167
  Gene Symbol: PERM1
  Gene Name: PPARGC1 and ESRR induced regulator, muscle 1
  Uniprot ID: Q5SV97
  ENST ID: ENST00000341290
  CDS Start-End: 37-2067
agacgcccagctcggccgccgggacccagggcatggatggagccccgaggcggtgggagctcccagttctcatcctgccctggtccggcgtcttctggagaccagatgcagaggcttctgcagggccctgccccacggccccctggtgagccccctgggagtcccaagtcccctggccacagcactggctcccagaggccccccgatagccctggagccccaccacggagccccagccgaaagaagaggcgagctgtgggtgccaaggggggtgggcacacaggagcctctgcttctgcccagacgggctccccgctgctccctgcggccagtcctgagacggcaaagctgatggccaaagccgggcaggaggagttggggccaggtcctgcaggagctcctgagcctggccccaggtcccctgtgcaggaagacagaccagggccaggtttgggcctgtctacacctgtccctgtgacagagcaaggcacagaccaaatcagaaccccgcgccgagccaagctgcacacagtgtccacgactgtctgggaagccctcccagatgtctcaagggctaagtcagacatggctgtgtctacacctgcctccgagccgcaacctgacagggacatggctgtgtctacacctgcctccgagccgcaatctgacagggacatggctgtgtctacacctgcctctgagccgcaacctgacacggacatggctgtgtctacacctgcctctgagccgcaacctgacagggacatggctgtgtctatacctgcctccaagccgcaatctgacacggctgtgtctacaccagcttctgagcctcagtccagtgtggctctgtctacacccatctccaagccacaattggacacggacgtggctgtgtccacacctgcctccaaacatggcctggatgtggccttgcctacagcaggcccagtggctaagctagaggtggcttcatctccacctgtctcggaggctgtgccgaggatgaccgagtccagcgggcttgtgtctacacctgttcccagagccgacgccgctggcctcgcctggcctcccacccgcagagctgggcctgatgtggtggagatggaggcggttgtgtctgagccctcagcaggggcccccggatgctgctctggggcacccgcactgggtctcacccaagtccccaggaagaagaaagtgcgcttctccgtggctgggcccagccccaataagccaggctcaggacaggcctcagcccggccctcagccccccagacagcaactggggcccacggggggcccggagcctgggaggctgtggctgtcgggccccggccccaccagcctcggatcctcaagcacctgcctcgcccccctccctctgccgtgacgagggtcgggcccgggagcagctttgccgtgaccctcccggaggcctacgagttcttcttctgtgacaccatcgaggagaacgaagaggctgaggcggcagcggccggtcaggatccggcaggcgtccagtggccggacatgtgcgagttcttcttcccagacgttggagcccagaggtcgaggcggcgggggtccccggagccgctcccgagagctgatcctgtgccggcccccatacctggagaccccgtgcccatctccatccctgaggtctatgaacacttcttcttcggggaggacaggcttgagggcgtgctggggccggctgtcccgctcccactgcaggccctggagcctccccggtcggcctccgagggggcggggcctgggacccccctcaagccagccgtggtagagcggctccacctggctcttagacgggcaggggagctccgggggcctgtcccatcatttgccttcagccagaatgacatgtgcctggtgtttgtagcttttgccacctgggctgtgaggacgtcagatccgcataccccagacgcctggaaaacagccttgctggccaacgtcggcaccatctctgccatccgctacttccgccggcaggtggggcaagggcgccgcagccacagccccagccccagctcctaggagccaggcccgggccagggagatgcaggatgaggagacgaccacaggcgcccagggcaggacgaggtgccgccctcgcccgggccctctgacccctctcttctaccgcgtccaggaggggggcgtgtcctggtgctgctccctccgactcacctgaggatccagccagtgaccacggccactccccacgcctgggagggaggtgctaaagtctgggtgggtggagggcaggcaggtggctgggtaggagggtggccagattcacagatgagaacacagggcattcggttaatttcagacaggcaatagtggggaggtcattttactaagaagttgttgtttatctgaaatcaaatgcaaccgcaccctgcgtttcttctggggtgcagggggagctgagtggcaggacaggacttggacctcggaggggtctgagcagcaagacactccggctggagctctgggcagaggcaggggagaggacacagggtggcctcaaagaggggatgggcagcctcctcacaggtgggctgggctggcaagggctccaaggcccatcactcttgatcctcaaaggactgtggccaaggcctctgcgggctctggcctgagacagcgaaggctctgcctgcccctccccagtgcagcagcccctgcagggtgggggtctgtggcagagccgcgagcccctccccgggagccctgggtgcaggtgcagagggagaattcggtggcctcagatggagggctgggctcctggggttgtcccgggggctcctgtggggcagctggggacccacagccaagaggagtcagagatgaggtgggaaggtcggtgaggggcccgaggtggcagaggaagggggctgcctggctgggtgctgggtgggggtcctcaagactgtgggagaccctggctgctgagcagagaacacatggatgcagcaccaataaaattctatcttttc

SEQ ID NO: 168491 - DNA, 3340 bp, Homo sapiens
  Payload ID: 13167
  Gene Symbol: PERM1
  Gene Name: PPARGC1 and ESRR induced regulator, muscle 1
  Uniprot ID: Q5SV97
  ENST ID: ENST00000433179
  CDS Start-End: 1-2373
atggaaaatttccagtacagcgtccagctgagtgaccaggactgggccgagttctcagccaccgccgatgagtgtggcctcctgcaggccggcctggcctctggggacgagctcttgtccagtgacattgaccaaggggacagcagtggcagcagtccccccagggccccacctctcccaactgggcagctagctgcaggagggcggagccggcggggctgcgaggaggaggacgtggccacacagcagccggtcagcaggtctcagggtgagcctgtcttggccctggggaccggtcagcagacacccagcacgtccgcacgggcagaagctccaccgtccctcggccccggcgccagccctcccagccagttctcatcctgccctggtccggcgtcttctggagaccagatgcagaggcttctgcagggccctgccccacggccccctggtgagccccctgggagtcccaagtcccctggccacagcactggctcccagaggccccccgatagccctggagccccaccacggagccccagccgaaagaagaggcgagctgtgggtgccaaggggggtgggcacacaggagcctctgcttctgcccagacgggctccccgctgctccctgcggccagtcctgagacggcaaagctgatggccaaagccgggcaggaggagttggggccaggtcctgcaggagctcctgagcctggccccaggtcccctgtgcaggaagacagaccagggccaggtttgggcctgtctacacctgtccctgtgacagagcaaggcacagaccaaatcagaaccccgcgccgagccaagctgcacacagtgtccacgactgtctgggaagccctcccagatgtctcaagggctaagtcagacatggctgtgtctacacctgcctccgagccgcaacctgacagggacatggctgtgtctacacctgcctccgagccgcaatctgacagggacatggctgtgtctacacctgcctctgagccgcaacctgacacggacatggctgtgtctacacctgcctctgagccgcaacctgacagggacatggctgtgtctatacctgcctccaagccgcaatctgacacggctgtgtctacaccagcttctgagcctcagtccagtgtggctctgtctacacccatctccaagccacaattggacacggacgtggctgtgtccacacctgcctccaaacatggcctggatgtggccttgcctacagcaggcccagtggctaagctagaggtggcttcatctccacctgtctcggaggctgtgccgaggatgaccgagtccagcgggcttgtgtctacacctgttcccagagccgacgccgctggcctcgcctggcctcccacccgcagagctgggcctgatgtggtggagatggaggcggttgtgtctgagccctcagcaggggcccccggatgctgctctggggcacccgcactgggtctcacccaagtccccaggaagaagaaagtgcgcttctccgtggctgggcccagccccaataagccaggctcaggacaggcctcagcccggccctcagccccccagacagcaactggggcccacggggggcccggagcctgggaggctgtggctgtcgggccccggccccaccagcctcggatcctcaagcacctgcctcgcccccctccctctgccgtgacgagggtcgggcccgggagcagctttgccgtgaccctcccggaggcctacgagttcttcttctgtgacaccatcgaggagaacgaagaggctgaggcggcagcggccggtcaggatccggcaggcgtccagtggccggacatgtgcgagttcttcttcccagacgttggagcccagaggtcgaggcggcgggggtccccggagccgctcccgagagctgatcctgtgccggcccccatacctggagaccccgtgcccatctccatccctgaggtctatgaacacttcttcttcggggaggacaggcttgagggcgtgctggggccggctgtcccgctcccactgcaggccctggagcctccccggtcggcctccgagggggcggggcctgggacccccctcaagccagccgtggtagagcggctccacctggctcttagacgggcaggggagctccgggggcctgtcccatcatttgccttcagccagaatgacatgtgcctggtgtttgtagcttttgccacctgggctgtgaggacgtcagatccgcataccccagacgcctggaaaacagccttgctggccaacgtcggcaccatctctgccatccgctacttccgccggcaggtggggcaagggcgccgcagccacagccccagccccagctcctaggagccaggcccgggccagggagatgcaggatgaggagacgaccacaggcgcccagggcaggacgaggtgccgccctcgcccgggccctctgacccctctcttctaccgcgtccaggaggggggcgtgtcctggtgctgctccctccgactcacctgaggatccagccagtgaccacggccactccccacgcctgggagggaggtgctaaagtctgggtgggtggagggcaggcaggtggctgggtaggagggtggccagattcacagatgagaacacagggcattcggttaatttcagacaggcaatagtggggaggtcattttactaagaagttgttgtttatctgaaatcaaatgcaaccgcaccctgcgtttcttctggggtgcagggggagctgagtggcaggacaggacttggacctcggaggggtctgagcagcaagacactccggctggagctctgggcagaggcaggggagaggacacagggtggcctcaaagaggggatgggcagcctcctcacaggtgggctgggctggcaagggctccaaggcccatcactcttgatcctcaaaggactgtggccaaggcctctgcgggctctggcctgagacagcgaaggctctgcctgcccctccccagtgcagcagcccctgcagggtgggggtctgtggcagagccgcgagcccctccccgggagccctgggtgcaggtgcagagggagaattcggtggcctcagatggagggctgggctcctggggttgtcccgggggctcctgtggggcagctggggacccacagccaagaggagtcagagatgaggtgggaaggtcggtgaggggcccgaggtggcagaggaagggggctgcctggctgggtgctgggtgggggtcctcaagactgtgggagaccctggctgctgagcagagaacacatggatgcagcaccaataaaattctatctttt

SEQ ID NO: 168492 - DNA, 1882 bp, Homo sapiens
  Payload ID: 13168
  Gene Symbol: PPP5D1
  Gene Name: PPP5 tetratricopeptide repeat domain containing 1
  Uniprot ID: E7EU14
  ENST ID: ENST00000414155
  CDS Start-End: 232-747
atccctccgcgccccgctccacacctacgggcccgcgaatctctcgtccccaccctgcacaggaattgggtttgccgccgggcgcgcgcgcgctcgctcccgtcgccggactactttccctcgccgcgcgccccgcctcccgggcccacttcactttcttcggcggaggggcacagctcggcggtgcgtgacgcgtccctctgtgagccgcgtcactattgggcctggcccatggcggaaatgagagcttggcgcccattggtccgaccttccctgcaatgcgtcaaactggggcgagccactgcaaggtggtggtgggtggtcaaggtgaagccccacgacaaggatgccaaaatgaaataccaggagtgcaacaagatcgtgaagcagaaggcctttgagcgggccatcgcaggcgacgagcacaagcgctccgtggtggactcgctggacatcgagagcatgaccatcgagggtgagtacagcggacccaagcttgaggacgacaaagtgacaatcaccttcatgaaggggctcatgcagtggtacaaggaccagaagaaactgcaccagaaatgcgcctaccagggtcttgctctatcacccaggctgaagtgcagtggtacgatcacagctcactgcagcctcaacctcctgggcccacgtgatcctcccacctcagcatcccaagtagctgtgaccgaaggcatgcaccaccacacctggctaatttttttatttttatagagatgggtctccctatgttgcgcaggctgatttcaaactcttggcctcaagcaatcctcccaccttggcctggggattacaggcgtgagccaccatgcccagcctccgtgtctttacatttgagaacaatttgtaggttagctttgtctttgtttttttagagatgggggtcttgctgtgtagcccaggctggactcaaactacagggctcaaggcattcttcatctcagcctcttgagtaggtttgactacagtcatgtgccactgtgcccaactacctttgtccgggttcctaggaattctccagaaggcagaatgagtacaaagaaaacacaggcaagtttctgttaaagagttacctgtggccacagttcctctggaagtttaacatagagttaccatatactatgctatcgccatccccaaattcatatgttgaagtcttaactcccagcacctctgaatgtgactgtatttggagatgggggtctttaaagaggtaattaaggtaaaatgaggccgggtgctttggtggctcacagctgtaatcccagcactttgggaagctgaggcgggcagatacctgaggtcaggagttcgagaccagcctgcccaacatggtgaaaccctatctctactaaaaatacaaaatttgcctggcgtggcggcatatgcctgtgatcccagctccttgggaggctgaggcaggagaactgtttgaactagggaggaggaggttgcagtgagccgagatcatgccattgcactccagcctgggcaacaagagcgaaactttggttcaaaaacaaacaaaaaaaaagtaaaatgaggtcccatgtgtgggcccttaatccaacctgactggtgtctttatgagaaaaggggaccaggacacagccccatgcagagggaagaccatgtgaggatacagggagaagacggccgtctgcacagccaaggagagaggcctcaggagacaccaacctatccaacaccttgattttggacttctggcctccagaattgtgaaaaagttaatttctgtcattgaagccacccattctgtgatagtttgttacagcagtcctcagcgcgtagaatacgatgccatttgtatggcagacagtctcattgt

SEQ ID NO: 168493 - DNA, 965 bp, Homo sapiens
  Payload ID: 13168
  Gene Symbol: PPP5D1
  Gene Name: PPP5 tetratricopeptide repeat domain containing 1
  ENST ID: ENST00000602017
  CDS Start-End: 1-377
cttccctgcaatgcgtcaaactggggcgagccactgcaaggtggtggtgggtggtcaaggtgaagccccacgacaaggatgccaaaatgaaataccaggagtgcaacaagatcgtgaagcagaaggcctttgagcgggccatcgcaggcgacgagcacaagcgctccgtggtggactcgctggacatcgagagcatgaccatcgagggtgagtacagcggacccaagcttgaggacgacaaagtgacaatcaccttcatgaaggggctcatgcagtggtacaaggaccagaagaaactgcaccagaaatgcgcctaccaggatttcagacaaaaatcaggaatcatcaccagccaagactgtgttcagaccacgtgacgtcttccaggcaccaggaagaaatacgaccaacctccgtaacaaatgagagaaacttcacctgactgtgttttgtgcatttggtttatgagtcgttttaaaaacgtgtacttttactgctgcgttcaggttttcagccatagaatattctagaaaaaaatagtgataacatttatttcaccgctataaccctgaatgtgtagctgtgttttttaaaaaaacatttttttacaattgtagaatatgtaacatgcctccagaaacgtgccctaaacacaaatatataatttggcaaataattacatagcaagtcctatgttactgtcatctgatctagaaatcatcgtcctcccagaagcccctcatgtgctctggccatctcaaatccctccctgccccagggataaataacatcctgttttgtgataaacgctgccttttctatacacgtgtatgcttattaacaaactatgaatttctccacacggtagatttgattatgtttgaatcttacatgaatgtaatcctattggtggattgtttttaatgtatgtgtgtgtgtgtttcagaaaaaatacattaagaaaa

SEQ ID NO: 168494 - DNA, 506 bp, Homo sapiens
  Payload ID: 13168
  Gene Symbol: PPP5D1
  Gene Name: PPP5 tetratricopeptide repeat domain containing 1
  ENST ID: ENST00000593359
  CDS Start-End: 1-394
ttccctgcaatgcgtcaaactggggcgagccactgcaaggtggtggtgggtggtcaaggtgaagccccacgacaaggatgccaaaatgaaataccaggagtgcaacaagatcgtgaagcagaaggcctttgagcgggccatcgcaggcgacgagcacaagcgctccgtggtggactcgctggacatcgagagcatgaccatcgagggtgagtacagcggacccaagcttgaggacgacaaagtgacaatcaccttcatgaaggggctcatgcagtggtacaaggaccagaagaaactgcaccagaaatgcgcctaccaggtaatgcacctgtcaggtaccgggcacccgggaaccctgggatggcatcacagcactgccaggcgcgggcactgagcaaaatgacaggagaagggcagccacaacagccaacaccaaacaggagtcgtggtcattatggattggcagtaatccctcccaatattcagatacaataaactatctctac

SEQ ID NO: 168495 - DNA, 999 bp, Homo sapiens
  Payload ID: 13169
  Gene Symbol: PPT2-EGFL8
  Gene Name: PPT2-EGFL8 readthrough (NMD candidate)
  ENST ID: ENST00000421600
  CDS Start-End: 1-389
atccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagg

SEQ ID NO: 168496 - DNA, 2878 bp, Homo sapiens
  Payload ID: 13169
  Gene Symbol: PPT2-EGFL8
  Gene Name: PPT2-EGFL8 readthrough (NMD candidate)
  ENST ID: ENST00000428388
  CDS Start-End: 569-1474
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 168497 - DNA, 4181 bp, Homo sapiens
  Payload ID: 13169
  Gene Symbol: PPT2-EGFL8
  Gene Name: PPT2-EGFL8 readthrough (NMD candidate)
  ENST ID: ENST00000422437
  CDS Start-End: 192-1097
agcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgacattgtcctggggcaaggggagcaccatcatggcctgtccacccaggtctttgcccacagggatgtcctcccagcctctccggacacaccctaccccagaactgctcaaagccctcacccgaggtgaagcgacgctccttcttgcagtagaagtcttggatgactcacgtcctgggtgagcagggtctgggcgacctcagacatgacactgatggcatcccccgtgcgcttccggtcgatgaagatgactcctgccagccagcaggccagcccggcagagccagcccacagtagctcgcgcttggcaatgggcacacagcggcctggcagtacctccatcatcccttgggcagggtgggagtgggtgaggatcggggtggaggcagagtgtcacagaaggcaacccacctcacccagctcatcaccctctggtagggactggaggtgaaggaggagactaggcagggaggggggccccaagtgaaggaaagggtgaccaaaagtatatgtaacctgcttatgagggcagttctacccagggaatgaaggcctgagtgggaggcaagggggcaatgtcccagaggaaggggaattgaggatctctaggagaagatattctagggaaggtttcaggaggggaggcatggctgggggaggtgtgccctgtggtggggtctcaccaagcagatcgagagagctctggtggttggagacaacaacatagggctgcgagggagggaagtggtgagcccctcgcacctccactcggatcccgtacaggtatttgatgtggagcagcattagacgcaagatcctgtggggtcatggcaaggggtcccagtgggatccattgatgtccatctgcatgcctcagctccccccaccttactgtctttctgaccacctttgcagtcctctccccattccctgtctctggtctctctcagtcttttctacacacaccatgcccccttcccccaatccactactcactttgtacccttaggttccctcattgcccaagaccccttgcccctcacttcatgttctcgacgttgcgtcctcgcacggcacacacagggatggcgagcacagccaggaagaggatccagccattgtagaaggccatcttgaagaagtacttggcactggggctgcagaaccacagggtgggcagcaggaagagcagcagcaggaagagcagcagcagcagcatccatgcccctggccacaaatccattctggccacctgcaggggatggggcaagggacaatcagcctggtttctggaggagagtggggctccggatatattcagacaagagacacaagacacagacatctacaattcacagatacctgataataaatgacaacaagaataatagctaacacttgtagctggtaagggtcttataatggtctatacttgtgctgtccgagaaagtagccaccacctacatgtggctacttgaaatgcagctagtctgaactgagatgtgctggaaatgtaaaatacacatcagatttcaaagactgaataaaaaacaaaatgtg

SEQ ID NO: 168498 - DNA, 1540 bp, Homo sapiens
  Payload ID: 13169
  Gene Symbol: PPT2-EGFL8
  Gene Name: PPT2-EGFL8 readthrough (NMD candidate)
  ENST ID: ENST00000583227
  CDS Start-End: 9-302
gcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgcca

SEQ ID NO: 168499 - DNA, 1051 bp, Homo sapiens
  Payload ID: 13169
  Gene Symbol: PPT2-EGFL8
  Gene Name: PPT2-EGFL8 readthrough (NMD candidate)
  ENST ID: ENST00000585246
  CDS Start-End: 344-637
gttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgtagggtccagcgtcaaagcgaatcatggggtccagggctgagctgtgcactctcttaggcggattctccttcctcctgctactgataccaggc

SEQ ID NO: 168500 - DNA, 2414 bp, Homo sapiens
  Payload ID: 13170
  Gene Symbol: PQLC1
  Gene Name: PQ loop repeat containing 1
  ENST ID: ENST00000351365
  CDS Start-End: 1-224
atcgggacattcgcaggacgcagaacgccgacggcttctccacctacgtgtgcctggtgctgctggtggccaacattttgcggatactcttctgcctctctgtccgggcagattggaaggtgtctgctgctcttcctatgaagagggcctggtggaggggtggagagaaggagtccaggcagctggtgtcaagaactctgcttctgactctggtcactgagtaatcacgtacctgcttctttgcctgtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctg

SEQ ID NO: 168501 - DNA, 2475 bp, Homo sapiens
  Payload ID: 13170
  Gene Symbol: PQLC1
  Gene Name: PQ loop repeat containing 1
  Uniprot ID: Q8N2U9
  ENST ID: ENST00000357575
  CDS Start-End: 158-919
cgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctga

SEQ ID NO: 168502 - DNA, 2555 bp, Homo sapiens
  Payload ID: 13170
  Gene Symbol: PQLC1
  Gene Name: PQ loop repeat containing 1
  Uniprot ID: Q8N2U9
  ENST ID: ENST00000397778
  CDS Start-End: 184-999
ggcgcctgagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctga

SEQ ID NO: 168503 - DNA, 1247 bp, Homo sapiens
  Payload ID: 13170
  Gene Symbol: PQLC1
  Gene Name: PQ loop repeat containing 1
  Uniprot ID: Q8N2U9
  ENST ID: ENST00000590381
  CDS Start-End: 173-571
ggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacgg

SEQ ID NO: 168504 - DNA, 2319 bp, Homo sapiens
  Payload ID: 13170
  Gene Symbol: PQLC1
  Gene Name: PQ loop repeat containing 1
  ENST ID: ENST00000474967
  CDS Start-End: 177-380
gagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctgagtcttgctctgtcgccaggctggagtgcagtggtacaatctcggctcactgcagcctctgactcctgggttcaagtgattctcctgcctcagcctcctgagtagctgggactacaggtgcctgccaccatacccaggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgcgggcactggtgggccctgacctccccgcggggagggtgggtgctgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaatt

SEQ ID NO: 168505 - DNA, 409 bp, Homo sapiens
  Payload ID: 13170
  Gene Symbol: PQLC1
  Gene Name: PQ loop repeat containing 1
  ENST ID: ENST00000478144
  CDS Start-End: 1-409
gcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctgtccttactaccattttgcaaaaccagcattcagcagatcacactctgtggaatgccaacattcaggatttggcaggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagacttcgacccccaccacttctggcagtggagcagcttctcggactacgtgcagtgcg

SEQ ID NO: 168506 - DNA, 856 bp, Homo sapiens
  Payload ID: 13170
  Gene Symbol: PQLC1
  Gene Name: PQ loop repeat containing 1
  ENST ID: ENST00000591964
  CDS Start-End: 149-394
gtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggctggagtgcagtggtacaatctcggctcactgcagcctctgactcctgggttcaagtgattctcctgcctcagcctcctgagtagctgggactacaggtgcctgccaccatacccaggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagtgctttgaatatgttattccactgccctctggactccattgtttctgatgagaagtcagctgttaatcttattggggtttccttacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgt

SEQ ID NO: 168507 - DNA, 704 bp, Homo sapiens
  Payload ID: 13170
  Gene Symbol: PQLC1
  Gene Name: PQ loop repeat containing 1
  ENST ID: ENST00000589452
  CDS Start-End: 177-380
gagcggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctgagtcttgctctgtcgccaggctggagtgcagtggtacaatctcggctcactgcagcctctgactcctgggttcaagtgattctcctgcctcagcctcctgagtagctgggactacaggtgcctgccaccatacccaggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctgg

SEQ ID NO: 168508 - DNA, 764 bp, Homo sapiens
  Payload ID: 13170
  Gene Symbol: PQLC1
  Gene Name: PQ loop repeat containing 1
  ENST ID: ENST00000593030
  CDS Start-End: 123-521
tgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggtgctttgaatatgttattccactgccctctggactccattgtttctgatgagaagtcagctgttaatcttattggggtttccttatcaggagtcaccatgcccaccaggtgtcccccgtgtccgccgacttctcctgactgaacttagagatctcatttcccgctgtctgagccaccccaggtcagcctcagccagcgttttccttacccagctcctccccgccacctgctccaattccccagcacatgtg

SEQ ID NO: 168509 - DNA, 2153 bp, Homo sapiens
  Payload ID: 13171
  Gene Symbol: PQLC2
  Gene Name: PQ loop repeat containing 2
  Uniprot ID: Q6ZP29
  ENST ID: ENST00000375153
  CDS Start-End: 641-1516
aagctgggccctggcggcggatctggacgtggtgagccggaccgggggcaggtggcaaacttcacggctgggggtcggggctcctgggcttccctgccacatccttccagccctctcctccggccgctggactgtcccggctcctgcgccctccttgtggcgcgatatcgtgggacgaggctccgggccgggactgggtggccctcgggaatccgcagccagtggccccccacctcaaaggcgaccagcgcggcctctcgagctggcctggccaggagttgccctgccccggccgaccggccccttggcatctgatggcttcgtttttcccgggccggccgggcgaggggccctcgcggcgctggccccagcagctgtcctatcattatccctccaaacaggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgag

SEQ ID NO: 168510 - DNA, 1805 bp, Homo sapiens
  Payload ID: 13171
  Gene Symbol: PQLC2
  Gene Name: PQ loop repeat containing 2
  Uniprot ID: Q6ZP29
  ENST ID: ENST00000375155
  CDS Start-End: 273-1148
agaagctgggccctggcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgaggaaacggtacctccccatga

SEQ ID NO: 168511 - DNA, 1548 bp, Homo sapiens
  Payload ID: 13171
  Gene Symbol: PQLC2
  Gene Name: PQ loop repeat containing 2
  Uniprot ID: Q6ZP29
  ENST ID: ENST00000400548
  CDS Start-End: 211-891
gcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggccagttcatcaaagcctacaagacgggcaacatggaccaggcgctgtccctgtggttcctcctgggctggattggcggagactcctgcaacctcatcggctccttccttgctgaccagctgcccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgaggaaacggtacctccccatga

SEQ ID NO: 168512 - DNA, 844 bp, Homo sapiens
  Payload ID: 13171
  Gene Symbol: PQLC2
  Gene Name: PQ loop repeat containing 2
  ENST ID: ENST00000432465
  CDS Start-End: 1-384
cccctgcagacctacacggctgtgtattatgtcttggcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaactcgtgcacacctcctgtgtgccaggcacccagctggaccctggagccgtgagtgagcaagaacagccatgagtgccccagaagcttacagcccagcggggcgcagagaggacacaacgctatcatcaaagaattacttcattgcagtggcaccaagtgctgcagagaaaaacaacaagagcgtctagccagggaccgtcctggttagaggggcagcaaaggcccctataagtctcattgaacctgtgacttgacagagtaggagaagtcaggcgaaggcaggagaggaatgttctaggctgtgcagacgagagctggagtgtggagagacacatgacttggtcagacaaacctgggttcaaatcctggctcctcccctgcttcctagctgtgtgacgcagggcacacagtcaacctctctgtgctgccgtgtcttcacctcagttaacagccactgtctcgtcaggatgttgtgtaagatgaggtatctggaaacactccccacaggaccc

SEQ ID NO: 168513 - DNA, 1512 bp, Homo sapiens
  Payload ID: 13171
  Gene Symbol: PQLC2
  Gene Name: PQ loop repeat containing 2
  ENST ID: ENST00000469076
  CDS Start-End: 222-329
gctgggccctggcggcggatctggacgtggcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggccagttcatcaaagcctacaagacgggcaacatggaccaggcgctgtccctgtggttcctcctgggctggattggcggagactcctgcaacctcatcggctccttccttgctgaccagctgcccctgcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgaggaaa

SEQ ID NO: 168514 - DNA, 1428 bp, Homo sapiens
  Payload ID: 13171
  Gene Symbol: PQLC2
  Gene Name: PQ loop repeat containing 2
  ENST ID: ENST00000497827
  CDS Start-End: 240-542
gcggcccgcgccgggctgagtcaccaggagggagctgtggccgaggacgccgaggcctggagtgggtggtagccccgagctgggacgctcctccctccacaatctccccaggtctgcagggaccgagggcctacactgcctcctcccacgccgtgcttaggaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccccagttcatcaaagcctacaagacgggcaacatggaccaggcgctgtccctgtggttcctcctgggctggattggcggagactcctgcaacctcatcggctccttccttgctgaccagctgcccctgcagacctggtgatgctgacgctgtacttttactacaagttcaggacgcgcccctctctgttgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaagcccttcacccggcaggaagtcattggcttcgtcatcggctccatctccagcgtgttgtacctgctttcccggctgcctcagatccgcaccaacttcctccggaagtccacccaggggatctcctactctctgttcgcgctggtgatgctggggaacacgctgtatgggctgagcgtgctgctcaaaaaccccgaggagggccagagcgagggcagctacctgctgcaccacctgccctggcttgtgggcagcctgggcgtgctgctgctcgacaccatcatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagt

SEQ ID NO: 168515 - DNA, 1201 bp, Homo sapiens
  Payload ID: 13172
  Gene Symbol: PQLC2L
  Gene Name: PQ loop repeat containing 2-like
  Uniprot ID: A1A4F0
  ENST ID: ENST00000312275
  CDS Start-End: 293-649
gctgcttcctgggaggtggtgctcgcaaacctggcagctgactgggtggggcgtgccttccctggcagtcgcggaggggaaggctgagggacccggtccccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagatttttacagccatcttcgacatgaacacggatgtaatcatactctcacaattcatgtactacaggttaaagaatcagaagaaaaaaatttctgaagaagatctacggaaggaacttcatttctgctgtttgcattggccatgattgggaacttcacgtatggacttggtgtggttttaaaggcaccagctgctacgtgtcacaagaatacttactttgtgcatcatcttccttggcttattgcaagttttggaatcttattccttaactcttttgtgtcttttgccatcagattgccattagagaataaacatgtatagctacttaatatatcacccaaaaagtacatatatatatatatatatatattctaagaagtgtaaatagctaatgctatagtcatttcattattatatttgaaatgttcatttataaggaaagtcttctctctcccaaagtctcctaattattattattctagcaaacgatcaaattcagatgaagatttcttggtttctttggttcttctgataaaaaaaaaaaagtggggccaagtttagaagcattgaaattaacacatcttagatattaaattttattaaaattataatagcagatattaagaaaaaaccataccatctctgaaaatctctacagagaacactttgaattaataaatgataactgatgccttgc

SEQ ID NO: 168516 - DNA, 1197 bp, Homo sapiens
  Payload ID: 13172
  Gene Symbol: PQLC2L
  Gene Name: PQ loop repeat containing 2-like
  Uniprot ID: A1A4F0
  ENST ID: ENST00000426338
  CDS Start-End: 95-496
gtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcaggatattccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatacataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccacagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctacaaacaccagggaagagcaagattgagttacatggcttggaagaagagtgaaacacctcgcaagacccagagaaaactccacatccatttgcagctaattttaaagcccaaataaaagcacaatcttt

SEQ ID NO: 168517 - DNA, 1484 bp, Homo sapiens
  Payload ID: 13172
  Gene Symbol: PQLC2L
  Gene Name: PQ loop repeat containing 2-like
  Uniprot ID: A1A4F0
  ENST ID: ENST00000449199
  CDS Start-End: 142-549
gccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagatttttacagccatcttcgacatgaacacggatgtaatcatactctcacaattcatgtactacaggttaaagaatcagaagaaaaaaatgatattccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatacataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccacagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctacaaacaccagggaagagcaagattgagttacatggcttggaagaagagtgaaacacctcgcaagacccagagaaaactccacatccatttgcagctaattttaaagcccaaataaaagcacaatctttggaatcactctatctttggtcaggcaaatgtttaaagagcaatattatatacatctagggtaagaacaattcattaatttagatgaatgaattgtcaaaaggttgttttgcctgtaaatgtgagtaaattgaatatcaagtcatcatgaaa

SEQ ID NO: 168518 - DNA, 563 bp, Homo sapiens
  Payload ID: 13172
  Gene Symbol: PQLC2L
  Gene Name: PQ loop repeat containing 2-like
  ENST ID: ENST00000461040
  CDS Start-End: 149-319
cggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaaggctgatgaagaaatctttacatggaatatgctgttcccatggacaaggagaagcaaaaagtctggtgaaaacacaccaaggcttataagactttcatcagtcctaaggatgagcagaagggtacaaatctgcctttgggaaatacatctgaaatgcagagataaacaagtttgcatctatgaaaggagaattggagagaggggagaattgaaaacacaccagtggttagaacagaagaggaaagtccactgccctttaagttgaaacagaaggaaagacatgaaggaaagccttgaatgaaatgaaataaacactgaaaccatactcagaaa

SEQ ID NO: 168519 - DNA, 883 bp, Homo sapiens
  Payload ID: 13172
  Gene Symbol: PQLC2L
  Gene Name: PQ loop repeat containing 2-like
  ENST ID: ENST00000468043
  CDS Start-End: 195-296
cccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagatttgaaaacaatttgtagccaacttcagtatgaatcaaagcattgttttaaaaggaaagattccttctgacattaaattgcattttccaagaaccagcaacatcaaccatccagactttaattatggaatcacaggtgcaactgcgtatctcctcagtagaggacaggaagatttgtgtgactgggactttatggatttggcatctcctgcaagatgtgtgtccaactcctgggaatactgtagcatgattatagaattggtttctattgtctgttttctgtttgttgctctctcataagttaagaatcttggatttcaagtctatagtgtaacactcttgttcataatttcttatttaaaaaaatgtttaaatatttctatattaagtattttttcaaactatttgggcttgctattgaacaaatgttctctttgtattgtatattttgaaggtgctaaaaagcatcactaaaacattttggaatataacagaaagatggttaatacattatactgactacttttttctcaattaagatatacaaatcttttatatttagtaatcagaaaggcaataaagcatatgtaccttacctcttcacca

SEQ ID NO: 168520 - DNA, 850 bp, Homo sapiens
  Payload ID: 13172
  Gene Symbol: PQLC2L
  Gene Name: PQ loop repeat containing 2-like
  Uniprot ID: A1A4F0
  ENST ID: ENST00000459838
  CDS Start-End: 162-380
ttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagttctgaagaagatctacggaaggaacttcatttctgctgtttgcattggccatgattgggaacttcacgtatggacttggtgtggttttaaaggcaccagctgctacgtgtcacaagaatacttactttgtgcatcatcttccttggcttattgcaagttttggaatcttattccttaactcttttgtgtcttttgccatcagattgccattagagaataaacatgtatagctacttaatatatcacccaaaaagtacatatatatatatatatatatattctaagaagtgtaaatagctaatgctatagtcatttcattattatatttgaaatgttcatttataaggaaagtcttctctctcccaaagtctcctaattattattattctagcaaacgatcaaattcagatgaagatttcttggtttctttggttcttctgataaaaaaaaaaaagtggggccaagtttagaagca

SEQ ID NO: 168521 - DNA, 1830 bp, Homo sapiens
  Payload ID: 13173
  Gene Symbol: PQLC3
  Gene Name: PQ loop repeat containing 3
  Uniprot ID: Q8N755
  ENST ID: ENST00000295083
  CDS Start-End: 176-784
aggggaggggcggagcgaggcgggtccggggcctggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttgaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacccgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaa

SEQ ID NO: 168522 - DNA, 696 bp, Homo sapiens
  Payload ID: 13173
  Gene Symbol: PQLC3
  Gene Name: PQ loop repeat containing 3
  ENST ID: ENST00000402361
  CDS Start-End: 13-375
gcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgcaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctca

SEQ ID NO: 168523 - DNA, 1784 bp, Homo sapiens
  Payload ID: 13173
  Gene Symbol: PQLC3
  Gene Name: PQ loop repeat containing 3
  Uniprot ID: Q8N755
  ENST ID: ENST00000441908
  CDS Start-End: 176-742
aggggaggggcggagcgaggcgggtccggggcctggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttgaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacccgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtctt

SEQ ID NO: 168524 - DNA, 928 bp, Homo sapiens
  Payload ID: 13173
  Gene Symbol: PQLC3
  Gene Name: PQ loop repeat containing 3
  ENST ID: ENST00000445921
  CDS Start-End: 117-626
ggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaaggtctcgctctctctcacaggctggagtgcagtgatacgatcttcactcactgcgggtttccaagtagctgggacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggttttt

SEQ ID NO: 168525 - DNA, 565 bp, Homo sapiens
  Payload ID: 13173
  Gene Symbol: PQLC3
  Gene Name: PQ loop repeat containing 3
  ENST ID: ENST00000445402
  CDS Start-End: 21-565
gaatctgggggcggggcgagatgagggtagtccgaggactgagcgagcccgggcgggcccgtaggcgaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaag

SEQ ID NO: 168526 - DNA, 831 bp, Homo sapiens
  Payload ID: 13173
  Gene Symbol: PQLC3
  Gene Name: PQ loop repeat containing 3
  ENST ID: ENST00000428481
  CDS Start-End: 1-247
gctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtgtatcctttctgaatctgagccagaagtgggaacggggatgttatttgtgaatgttcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttgaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcacttt

SEQ ID NO: 168527 - DNA, 4675 bp, Homo sapiens
  Payload ID: 13174
  Gene Symbol: PRDM1
  Gene Name: PR domain containing 1, with ZNF domain
  Uniprot ID: O75626
  ENST ID: ENST00000369089
  CDS Start-End: 147-2222
cagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaat

SEQ ID NO: 168528 - DNA, 2612 bp, Homo sapiens
  Payload ID: 13174
  Gene Symbol: PRDM1
  Gene Name: PR domain containing 1, with ZNF domain
  Uniprot ID: O75626
  ENST ID: ENST00000369091
  CDS Start-End: 221-2590
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattt

SEQ ID NO: 168529 - DNA, 5164 bp, Homo sapiens
  Payload ID: 13174
  Gene Symbol: PRDM1
  Gene Name: PR domain containing 1, with ZNF domain
  Uniprot ID: O75626
  ENST ID: ENST00000369096
  CDS Start-End: 235-2712
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaa

SEQ ID NO: 168530 - DNA, 583 bp, Homo sapiens
  Payload ID: 13174
  Gene Symbol: PRDM1
  Gene Name: PR domain containing 1, with ZNF domain
  ENST ID: ENST00000424894
  CDS Start-End: 395-583
ccttttcagtcttccatgtgagaggatgaaagagagctcgcagcagagggaggaggcagttgttttgaaagttgttttgcgttgggagctggtgggaaagttcggtcttccccatttggaaaaggcaggctgggttccgctcctgcaccacacgcgctttccatttttagcttcattcagaggcagacagagctccttcctcttcctctccttgtttgtgacacttttctgaggcagcttttccacagtgccgagggtctggcggccatgaccccaggcattctgggacactggactgtgtgcccagaacatttttctgccatgagaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttatt

SEQ ID NO: 168531 - DNA, 583 bp, Homo sapiens
  Payload ID: 13174
  Gene Symbol: PRDM1
  Gene Name: PR domain containing 1, with ZNF domain
  ENST ID: ENST00000450060
  CDS Start-End: 69-583
aagaggaaaagtgacttctcagtaatagactgtcaaattcgggctgctgcccgagtgttcgctttgttatggcaggtgaagttcacctttgccccacccagtgtttccacaaaaagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgccctt

SEQ ID NO: 168532 - DNA, 4247 bp, Homo sapiens
  Payload ID: 13174
  Gene Symbol: PRDM1
  Gene Name: PR domain containing 1, with ZNF domain
  ENST ID: ENST00000613999
  CDS Start-End: 277-2643
ggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgcccaccccatgctcaaccccacttctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaaggg

SEQ ID NO: 168533 - DNA, 5817 bp, Homo sapiens
  Payload ID: 13175
  Gene Symbol: PRDM10
  Gene Name: PR domain containing 10
  Uniprot ID: Q9NQV6
  ENST ID: ENST00000304538
  CDS Start-End: 148-3219
caaaaatgaagccagctcttcctcacagccggtagatggaagtcatttttccagggcctggaaggagttggtaggaagactagatttcagccagcccttgcgccctgtttgtgccagcaggcaccagcgaaccaaaagcaggtgtccatgtctgcttactctgtgccttcaacttttgcccaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgaaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacggtcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgaa

SEQ ID NO: 168534 - DNA, 6322 bp, Homo sapiens
  Payload ID: 13175
  Gene Symbol: PRDM10
  Gene Name: PR domain containing 10
  Uniprot ID: Q9NQV6
  ENST ID: ENST00000358825
  CDS Start-End: 233-3715
actctgcggcgggaagaaccacctggaggtggcggggggggttgatttctatcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgcactttgttccggacacaggaacagtggctcagattgtctataccgatgaccaggttcgccccccacagcaggtggtgtacacggcagatggtgcctcctacacatcagtggatggtccagagcacacgctggtgtacatccacccggtggaagctgcacagactctgtttacagaccccggccaggtagcttatgtccaacaggatgctacagctcagcaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgattggagctgcagaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtcagcgagcctaccgcctcggccccgtcctccgcccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacggtcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgaagctacaaga

SEQ ID NO: 168535 - DNA, 6301 bp, Homo sapiens
  Payload ID: 13175
  Gene Symbol: PRDM10
  Gene Name: PR domain containing 10
  Uniprot ID: Q9NQV6
  ENST ID: ENST00000360871
  CDS Start-End: 233-3703
actctgcggcgggaagaaccacctggaggtggcggggggggttgatttctatcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgcactttgttccggacacaggaacagtggctcagattgtctataccgatgaccaggttcgccccccacagcaggtggtgtacacggcagatggtgcctcctacacatcagtggatggtccagagcacacgctggtgtacatccacccggtggaagctgcacagactctgtttacagaccccggccaggtagcttatgtccaacaggatgctacagctcagcaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgaaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtcagcgagcctaccgcctcggccccgtcctccgcccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacggtcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgaa

SEQ ID NO: 168536 - DNA, 5998 bp, Homo sapiens
  Payload ID: 13175
  Gene Symbol: PRDM10
  Gene Name: PR domain containing 10
  Uniprot ID: Q9NQV6
  ENST ID: ENST00000423662
  CDS Start-End: 217-3402
agccctcccaggtgtgggacagaaggggcagagggagggcagaggcttaaaggctgtgagcagtcagatcaaaaatgaagccagctcttcctcacagccggtagatggaagtcatttttccagggcctggaaggagttggtaggaagactagatttcagccagcccttgcgccctgtttgtgccagcaggcaccagcgaaccaaaagcaggtgtccatgtctgcttactctgtgccttcaacttttgcccaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgattggagctgcagaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacggtcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtg

SEQ ID NO: 168537 - DNA, 6182 bp, Homo sapiens
  Payload ID: 13175
  Gene Symbol: PRDM10
  Gene Name: PR domain containing 10
  ENST ID: ENST00000528746
  CDS Start-End: 233-3586
actctgcggcgggaagaaccacctggaggtggcggggggggttgatttctatcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgcactttgttccggacacaggaacagtggctcagattgtctataccgatgaccaggttcgccccccacagcaggtggtgtacacggcagatggtgcctcctacacatcagtggatggtccagagcacacgctggtgtacatccacccggtggaagctgcacagactctgtttacagaccccggccaggtagcttatgtccaacaggatgctacagctcagcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgaaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacggtcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtg

SEQ ID NO: 168538 - DNA, 620 bp, Homo sapiens
  Payload ID: 13175
  Gene Symbol: PRDM10
  Gene Name: PR domain containing 10
  ENST ID: ENST00000527581
  CDS Start-End: 202-620
gcggggggggttgatttctatcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgcactttgttccggacacaggaacagtggctcagattgtctataccgatgaccaggttcgccccccacagcaggtggtgtacacggcagatggtgcctcctacacatcagtggatggtccagagcacacgctggtgtacatccacccggtggaagctgcacaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactg

SEQ ID NO: 168539 - DNA, 3308 bp, Homo sapiens
  Payload ID: 13175
  Gene Symbol: PRDM10
  Gene Name: PR domain containing 10
  Uniprot ID: Q9NQV6
  ENST ID: ENST00000526082
  CDS Start-End: 56-3280
agcccttgcgccctgtttgtgccagcaggcaccagcgaaccaaaagcaggtgtccatgtctgcttactctgtgccttcaacttttgcccaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgattggagctgcagaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtcagcgagcctaccgcctcggccccgtcctccgcccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcac

SEQ ID NO: 168540 - DNA, 2643 bp, Homo sapiens
  Payload ID: 13175
  Gene Symbol: PRDM10
  Gene Name: PR domain containing 10
  ENST ID: ENST00000533431
  CDS Start-End: 49-2643
catgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgaaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtcagcgagcctaccgcctcggccccgtcctccgcccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagc

SEQ ID NO: 168541 - DNA, 528 bp, Homo sapiens
  Payload ID: 13175
  Gene Symbol: PRDM10
  Gene Name: PR domain containing 10
  ENST ID: ENST00000531431
  CDS Start-End: 183-528
atcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgcactttgttccggacacaggaacagtggctcagattgtctataccgatgaccaggttcgccccccacagcaggtggtgtacacggcagatggtgcctcctacacatcagtggatggtccagagcacacgctggtgtacatccacccggtggaagctgcacagactctgtttacagaccccggccaggtagcttatgtccaacaggatgctacagctcagcaggagactgacttcagcatgatgaaacaaacaggcacctcatctctttcattct

SEQ ID NO: 168542 - DNA, 1858 bp, Homo sapiens
  Payload ID: 13176
  Gene Symbol: PRDM11
  Gene Name: PR domain containing 11
  Uniprot ID: Q9NQV5
  ENST ID: ENST00000424263
  CDS Start-End: 246-1679
agttctcgcggacgccctcggccccgcgccgggggctgctgcggggtgctcggggatgaaggtgggaggcgtcctttgggatgcgacgaagccttctccatcgcggttcgcgattgcccgcgaagcgtggccgagccggagggcatttctggaatgcgttttaagtgtcagttgcggtgtagactcttcgggaaacctctccggagcgtagcctccaccccccactcgcagtccccaaggacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaggggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggctttgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtagcctaaagctctctgtggaaaccaccttccgggagacctgaggagtgtaacgtggaggcggctacctccgtgggtgggagcccaggtcctcagtgtctctggcagacccatcggcagctctgccaggtgctccatgtgttgcccttgtatcctccttgtcaataaaggaagttccgctgc

SEQ ID NO: 168543 - DNA, 762 bp, Homo sapiens
  Payload ID: 13176
  Gene Symbol: PRDM11
  Gene Name: PR domain containing 11
  ENST ID: ENST00000526442
  CDS Start-End: 210-762
ggggaggagagcagcagcgagtcgccgccgccgccgcgccgaggctggcgctgaaactttgcctcgccggggaccagcgcgcccgcagcgcggccgctccctccgcgggggccgccagccgaggccgcgccgcctccgccgagccgcccgccgggccgctctcgccgcccgggccccgcggctgccgcagcattcccgggaaggacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaggggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatga

SEQ ID NO: 168544 - DNA, 1536 bp, Homo sapiens
  Payload ID: 13176
  Gene Symbol: PRDM11
  Gene Name: PR domain containing 11
  Uniprot ID: Q9NQV5
  ENST ID: ENST00000530656
  CDS Start-End: 1-1536
atgttgaagatggcagagccaattgcatccctgatgatcgtggagtgccgggcctgcctgagatgctcacctctcttcctttaccagagagagaaagacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaggggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggctttgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtag

SEQ ID NO: 168545 - DNA, 3111 bp, Homo sapiens
  Payload ID: 13176
  Gene Symbol: PRDM11
  Gene Name: PR domain containing 11
  ENST ID: ENST00000534751
  CDS Start-End: 1-1441
ccagccctgctctaggagaccggactcctcggccatggaagttgagcccaagaaactgaaggggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggaatgtggcacacctggctgagcgtaagaggaagcccaagttctccaaggaggagctggacattcttgtcacagaggtgacccaccatgaagcagtgctctttgggagggagaccatgcggctgtcccatgctgacagggacaagatttgggaaggcatagcccggaaaatcacctccgtcagccaggtgccccgctccgtcaaggacattaagcacagatgggatgacatgaaacggaggaccaaggacaagctggccttcatgcagcagtccctgtcgggccctggggccgggggccgggcccccaccatcgtgctcacggcccacgagagggccatcaagtcggcgctgctcacggcccgtgcagggcgcggcttccccagggcggaactggatggcaccgacagcccttcgaccagctatgatgaagatgaggaggcgcctgggccctcaaggcagcctcttcgggtgcctctgcagcggtctccggaggaagaggcccacctggccaggcccgccctgctccgttcatcctcctcctcagaccagtctgagacggtgggccccaagccagaggccctgccccatccctcgccccaggcccaggctgcctgcaggacccctcggccgcaccccagcccacccaccacgggccttgactggcagctcctccacgtccatgcccagcagaccgaggtgttccggcagttctgccaggagctggtgaccgtgcaccgggacatggccaacagcatgcacgtcatcggccaggccatggccgagctgaccagccgtgtcggtcagatgtgccagacgctgacagagatccgggatggggttcaggcatctcagcgggggccagaaggggcagaccctacgggctccactccccaggccacccaggcccaagcccccctgccagagcccccaccagcttccccagcatcagcccccacacggactaccaggtctcggaagagaaagcacaatttctaacccagctagtctgcactaggaggaagagtcatggaggagggatgtctggcctcacaacaggggccagtctttcgtgtccaggaacaggatcgatgacccttgtaggacactgggggcgctgttacctcctcaccgagcgcaggtcgctgccctgtggtctaacagagcatgtattcagacccgcaccctcatctttggcggatgctgaagatgcaagaaaagccacctgcttgatgcttgcttggcctggagatcgttctcctcttggtctgtgtcccgtggtggcaggccttgcagggaggggggcgcaacagtggggagcatccgaatggagtcccactttccaaccttggggctgctgcatcggcctcccacatgtgacctcccaggccctgatgctgcttcttttgaagggggtgaggcctgatgggcaggtcaagtcggtccttcagggaggggtctaccctcccttgcccgggggtggtgcccgccttggccctccgcttgcccttgtgcgcgtgctcagctgctgtgcttgccttttttggagtggggagaagaatgggatgacgtcggaggaaggaaaagactgtcttgcattcatagagagcactttatgcttttcctcgcccttgcagagtctgggtggtctcagtgggggctcaggacagtcagctcaagacagccaagtcaggtattattatgatcatttttatcatcatcatctgtataagacaaatgacacagccagttagtgagagggccaggactggaagccagggtatcggttttcccagctcccctgtcagaggccagatctggagtagtgggaagaggaggcagggggcaggtcttgccccttgccaggcctctgccccttgccaggcctctgccccctgtatctctgcttctgcctcagctgtcctgggtgaggtgggaggcacctagcatttagcaggtgattctcccaccctgccctggctctatggctcatagccagtggcttggagaggcagggccagatctcaggagtggagggcaacctcttccctggcttctaaaagaatccagagcccagtggggctcatgtcccattccaggttccagcatgccttgcctctgcttgctcgggctgcctacgcactagctacatacacctctagcttcatgtttcatgttggagtgtggggagaaaactgggttcttagcattagagagggaagtggcaggtggcagatacaagcttagctctgacctgggtgcacctcagctctgtgtccttttttttccctgacctgaagctgaccccagcagaagtcccccagccaacccctccacccaacaaccccccaccctcccatcctgcccccagccatagtgggagctgggaggattgcagcatctagtgccttccaaggctgttcctggagcgctgcttgtaaacccaagccaagctttgtcccacgtagggagaatggaaggtgactgcaatgtccctgtgcctttggctccatctccccattctgtggttctttgggggttcctgcttccctcaaactgaacactctcctgtccaacagcctgatggcttaattattgcctggaattgcccggcctccgatgctggaatcaaagattgccttccgaagtatttttgttaagatggcaat

SEQ ID NO: 168546 - DNA, 10744 bp, Homo sapiens
  Payload ID: 13176
  Gene Symbol: PRDM11
  Gene Name: PR domain containing 11
  ENST ID: ENST00000622142
  CDS Start-End: 246-3779
agttctcgcggacgccctcggccccgcgccgggggctgctgcggggtgctcggggatgaaggtgggaggcgtcctttgggatgcgacgaagccttctccatcgcggttcgcgattgcccgcgaagcgtggccgagccggagggcatttctggaatgcgttttaagtgtcagttgcggtgtagactcttcgggaaacctctccggagcgtagcctccaccccccactcgcagtccccaaggacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaggggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggctttgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcagcctcagaaagcatggtctccggccccgccatcatggaggatgatgaccaggaagtcgattcagcagatgaatctgtctccaatgatatgatgacagcgacggatgagccctccaagatgtcatcggccaccgggcgccgaatccggcgctttaagcaggaatggctgaagaagttctggttcctgcggtactccccaaccctcaatgagatgtggtgccacgtctgccgccagtacacggtgcagtcctcacgcacctcggccttcatcattggctccaagcagtttaagattcacaccatcaaacttcacagccagagcaacctgcacaagaagtgcctgcaactgtacaagctccgcatgcacccggagaagacagaggagatgtgtcgcaacatgaccctgctcttcaacaccgcctaccacctggccttggagggcaggccctacctggacttccggcccctggcggagctgctgaggaagtgtgagctcaaggtggtggaccagtacatgaatgagggagactgccagatcctcatccatcacatcgcccgggccctgcgggaagacctggtggagcgcatccgccagtcaccttgcctcagcgtcatcctggatgggcagagcgacgacctgctggccgacacggtggctgtctatgttcagtacaccagcagtgatgggcccccggccacagagttcctgtccctgcaggagctgggattctctagcacagaaagctatctccaggcacttgaccgggccttctcggccttgggcatccggttgcaggatgaaaagccaactgttggcttgggtgtagatggagccaacatcacagccagcctccgtgccagcatgttcatgaccatccgcaagacgctgccctggctgctgtgcctgcccttcatggtgcaccggccccacctggagatcctggatgccatcagcgggaaggagctcccatgcctggaggagctggagaacaacctgaagcagctgctgagcttctaccgctactcaccgcgcctcatgtgcgagctgcggtccacggcggccaccctttgtgaggagacagagttcctgggcgatatccgggcagtgcggtggatcatcggcgagcagaacgtcctcaacgctctcatcaaggactacctggaggtggtggcccatctcaaggaggtcagcagccagacccagcgggcagacgcctcggccatcgcactggccctgctgcagttcctcatggactaccagtccatcaagctcatctacttcctgctggacgtgattgctgtgctctcgcgtctggcctacatcttccagggcgagtacctgctggtgtcccaggtggatgacaagatcgaggaggccatccaggagatcagccggctggctgactccccgggagaatacctgcaggagttcgaggagaatttccgagagagcttcaacgggatcgccatgaagaacctcagggtggctgaagccaagttccagtccatcagggagaagatctgccagaagacccaggtcatcctggctcagaggttcgactcccgcagccggatctttgtgaaggcctgccaggtgtttgacctggctgcctggcccaggagcagtgaggagctgatgagctatggcaaggaggatatggtgcaaatatttgatcacctggaggccatcccgaccttttcccgggatgtctgtagggaagggctggacccccggggtagtctgttgatggagtggcgagaactcaaggctgattactacaccaaaaatggcttcaaagacctgatcagccacatttgcaagtacaaacagaggtttccactcttgaacaagatcatccaggttcttaaagtcctccccacttccaccgcttgctgcgagaaaggccgcaatgccctccagcgagttcgcaaaaaccaccgctcccgcctgaccctggagcagcttagcgacctgttgacaatcgctgtaaacggaccgccaatcaccaactttgatgccaagcgagccctggacagctggtttgaggagaagtctgggaacagttacgcgctgtctgcagaagtcctcagtaggatgtctgcgctggagcagaagccagcactacagaccatggaccacgggacggagttttaccccgacatttagggagctggcgctgcagagttcactaagctgttgaatatttttttaatctatactcataagctttgatatattatataaatatatattatattatattatattatattatatatatatatatatataaactcacactgaaaatttttaaaaaccaaggtgacgcgtccaccagaagccactgggagatttcagaaaggaaaaatgttggaaactgactcttgtctacaaaatttggcagctgcaacatacatggcaactcattttcactcacagaagcacgtgctggggcctcctgtgttcccaccttactgtccaccaacagcataagctaaaatgacaggtctctgtcatcacctttaggtagctcattttgtttatgttttcatttgcgggtggcggggctctgggtttgggtttatgttcttgccttttcttttttcatttggttttatgatgggagggagctcctcagcctcctcattgacattctggtccggctgaatcagatctctgacttaagtcagggtgggttgtctgtctgcatttgggaggcaggggggttgacctttctccctccccacctgacttcagcttgagatctttttttattcatttcctgatgagggttccttcactgtcctacaaacaaaagtgtcggtcaaactgtgacactgccacacctcacctctgttgcctcgtccatccctgggttgtggatcccttccttccagccccccctggaaactcacaatattacccattatactgaaggcaacattgcctcaccgctgagcttgaaatcctggggaagggagaaggggtaagcttttagcattcctgtttttacgaggtggaggataaaacaatataattccattccaatccagggcttttggggagatgaagagccaagaagtccagaccccaacaggggagtgatttttggctaaaaaacaaggaaaatgaaaagtacatattcgagttacatggattatttatactttttctttataatcatatcatgtgttgagggtattttttttcctttaataatcaagaaatgcctgctatagttcagtggcaggtagtgtcaatgcaaattgtgccctaagttatgcataactcaaatgagagtctgtagagatgtggtcctccttttgcaacaaggctgataacatgctacatggtcataggaaactggggaatgtgtctctgcctgtaaactcttccttttttgaacagggtagagatgtcctaaagaaatggagaaaagaagagaggactctcaaggcatcagcctacacagacacacacacacacacagacacacacacacacacagacacacacacacacacacaatcacaatatacaatataagctttagaaatagccacttgcctattccctggggcaagtagtggtttaaactagaggagtctgatcaatgctctttcattcatttaactaccggtatacctcgcaagggagttttaaaaaatgtgcgtgagctgttaaaaacttctgttcatgttcctacatctgatttatgcatattttatatgcagagatcctatcacgtggatgcaggtcattttgggggagggaggaagatctgaattatatacatgtggtcagttctgctgagagcttcatctcttggttggcagagggtggtgttatctggccacaggcaaggccccaatgtcttcagcctgcttggttcagacattataaaactgtggtggcttccttccttcttggtttatgttgtctctgaggcctcatgccaccgttgagaaccatagtggaaatgtcatcaacactgaacatgttatagccctttcttggttccaccagtcccttcatcccctaccaatcccttccccttcacctccatggtcttggtgctaagataactttagaatcattgctgctagtcaatagcttttcattatataaatatattatatatattatatattatttttgaaatatttttgtttgttttcaacagtgatgtagcatgttaaaaaacaaaaaacaaaaaaaaatgggttcctccaactgtcccactgccaggcctcatatgctgccttcttcaacaaatcaatgcacccctgcctggtgacatccaccccacctcccaccccagttgcacacatgcttccctaccctcctctgagcaagaagacagttagcaggaactagcaaggaaaggctgaaagcctccttctgaggctttgagattcccagccccattccacttccccactttaaactgatgtctccctccatctgctcctcccatcagggtcaaaacctaactgtggtcaaatgggatgctgttgcaaagcaccaggtcccacctggcccagccccagccttgggacttcctctcccctcacacacgcaaactgctgtgtctggggagttttcactgaacattgcagagactaagaagggttgagggcagagatggctagcaagacagggcttggtgagggcagaaacagtaggttgagatcctttcttctagccaacagttgccttacaccttacattgggtaatgggtagggaggagcaggctaaggctcccgctcatttgaaaaccaggaagagagaaccagtgtcttcctgagcacctggtcagttggagctactctttttcctctcaagagatcatggccaaaatgagctaaaatcttcagctagaaggggaaaagcttatgggccagtgccagtgcctaccctgtagttcctgagaaagctgagagcaggtgacccacttctggcctagcagaatgagctgctatgcacagcatgcagctgcaggggtcacttcctgagctggccaccagacctcggaaaagctaacctctcaggtggtcttgaagttaggttagggcatccctaaaactctgggtgcttgtggcttctgctgaatttagccatgccagggctgtggcagacactctgtaggccacactgccatgggacagggaataatttgggtgatacaccactgcaatttacacggggtctcttctcagcttggatgctccctgggaggcccagtgcttctgtcctgtgaattctgcatgtgattacccatgatttctgtcataggcatttcccactcttctgcttgcttgagaaggacttggactgatgggacactcagggtctagcccagggagcatatgcttggctaacctaatctccccttgatgtgtatacagaactgtggaaaagcagttggtggatcccaaatgttgttacttcagacaagacagagccctttaactcagcctctggcttaggagtgatgactacaggcttagaatgaagtgtgtctctggggctgagacttggcataactgggctggctgattagtgactttctttggctcgtagggttggtgggaagtgagatcaaccttgaggcccaggtttgtggccaactgtgccaaggtgatacctggcagagcctgggagccagagcccttatgattaatatgatctgcttttccttcatggaggacaaagaaaaaatccactgccatctagtatctgtgaaacatgaggacagcgcagtcaagtctgtaactcttgccatgtcagaatccccaagttttgcctgcctggttgaatatgagagtccaggcatcagaaacagcagccttatttaatttaatttttctaatgactggcctatgacaccttgtgatgctaggcacatcctcatttccccatcctcacttgggactgagagcaggctcaagttccagggtccctggatggcaaggttcagtgctgggccctggaatctatggcacttgggggtctctgacctcagcctctgccacatgtttccaagttgagttgttttgctgaggtggtcctccccttgagttgcttatgccaaccctttaatttaggaaaagtaccttgtaattacttaaggtaatgtttaaatgttttccattcatttggaggtggtgccaacaggggggaaagcatgcagaaggctggaaacaatagctgagaccctactgtgggcccacagccctggcccagccggcactgaggggctggtgccatgttacttgatcacctggagcctgatgggacccaggaggtggcctgaggggttgaagtataacttccctcttctggatcccccctttcattttccttctaccccctctaggaatgggagttctagacctaggtctgcttttggctttcagtctgggttgatttccaagtcgaattcatgctttttcttggcccataggtccaattttggcagaaggcattggacttgtgccccctccctgcttcaagaggcagatctagccaggccaggctgaaacagctgaaacaggcaggccagtcctcctcagacaagaaaggggttttcagagggcagtggtgtgcccattccagacaccagtcttctggggaggtggtgccgtgtcatgggttctagtctggcctcttcctcagtcctcaggaggacccaagagactggcacggcccttctcctgcttggagggaaacccatctcccacttggtgggggcccttctcttgccatctgttggttagggtgcttgagctgagtggatggtgctgtgatatttttaaggagcctttcaggcaatgtttgcatgttagccagagggagaaaaagtgcccttttgggaggaaaatggtacgcccctccacttccatctggcactcccttcccccccaccccctcaagtggtatcaccctggaaatacctatgcaatccagtctccctaggagagagtgcatggaagcaggggtatgtgcagtgtagaatacagatgctacagcatatatgttgtatatatggacatatacagtacgtatacacacagagtaagagagtaaatcacgtctatatatctataaataatatcctatatatttatacatttctatgttttaaatagatataaaaatagagtctatagagctgggagagcagtgggaagcctggcgctgtgctgtgcaaaggggaagggagcacggccttcggagagggagccggggaaggccagcaggcagggttggctggcaagggggcctcctacccggagtgttggagaggagagtggctgggtcccggctcgctccatgcactttctctccttttccacaggcttggtctgaggttggaaggagataccccctgagctccagctgaggtgccccctacctctccccacccccacagcccacgcttaggcggtcactgctgcttggcagtaggacgtggtctctgactcctggtggagggaccactgcacaaactccttcaaaaccctcccgcaccaggactgagcagcgtcagtggcaataggaaaggtccaaactggatcaagagctggtccaggaaagataccgcccctgccctgttagatgcttctgctgcccctagaggccaagcccctgaagtgcagccgtcctggcctccctcacttgctcaaccactgtcaggaggagaggatgtgggcagcatgagcatcgccaggcagcgctgcccaccatccacaggctttctggccagggcagggggcatcagctagcaggaaacggtgggagagacatatctgcacactcataaattcaatggctactccagtccagaagcagggctttggcccagcccgctccgcgcagcagctgctgctggctgtactcaggacaacgctgttccccctccctcacagaggccccgtggcccctaccccactcccgccgtaacaggcaggtttagttcacatacactgttcgcattctgtgacttgaggcagaggctgagctgggataccccaagctcatccactttcgttggggagggcccctccctgggtttatcaccagctcctagcccgggccgggcggggatgtctgggggccacgcgggggcactggtgcaagctggcagcatgacagagggcttgtgcagccctgacgggacccagaagcccatttgctcgcagtttcctctctctgtttttttcctcctggaggtaggagagagggcctgaccaggcaccagatgatggagcaagggcagctgcatgctccctctctccagaccagccttctgcttttggggtccgaaggggcatttgctcccatcctgagcctcctctgcccctgtcttgctcttccccaccatcctacaagtacctcagtctccagcaggcccacccctccacctgcagcccagggcgggtctgttctgccaatgcccacctccttgagccacagttagctgccaactgggtcttgggacaccctccagtacctggctcaagagagaccaggccgggccgagccttcttcccactgcagtggactagacccacggccaggggatgggcatccccaggtagcaatcccacaatgcactgtacctcagagagagagcacgccaggggcaccaagggaccgagccctctgtccagagggggacagcggtcacaatactgctcaccaaaagacaaaggccaggctgccctcgggcacctctcagtcttcacttttgtctctccggaagaaccagcagtctgattccgtctatttcagcccccgtctctctcttctccacccccacgctgctgaaccattttcatgtcaatcacaaaggaaaaataagtggggatggggggaaatacctaggagtctattatcacatacatattaatatgttaatactttctttaaaaaaaacctcttgatgttattattttgcagactacgctttatagtacctgtgtgacgggacctagaacactggatacaaatagagctatgttggtttatcataatatgtacgcagaaactttctttttgtcatattatccttgtaatgtaagaagattgttaataaaagcatttaaatttactcaccactgttgaa

SEQ ID NO: 168547 - DNA, 2476 bp, Homo sapiens
  Payload ID: 13177
  Gene Symbol: PRDM12
  Gene Name: PR domain containing 12
  Uniprot ID: Q9H4Q4
  ENST ID: ENST00000253008
  CDS Start-End: 61-1164
cccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcaccgccgaggtgctggcgcagtccttctccggcgaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtgttcaatgaggatggcacggtgcgctacttcatcgatgccagccaggaggaccaccggagctggatgacctacatcaagtgtgcacgtaacgaacaggagcagaacctggaggtggtccagatcggcaccagcatcttctacaaggccattgagatgatcccacctgaccaggaactgctggtgtggtacggaaactcacacaacaccttcctggggatcccaggtgtgcccgggctagaggaggaccagaaaaagaacaagcatgaggacttccacccggcggactcggcggctggccccgcgggccgcatgcgatgcgtcatctgccaccgcggcttcaactcgcgcagcaacctgcgctcgcacatgcgcatccacacgctggacaagcccttcgtgtgccgcttctgcaaccgccgcttcagccagtcgtccacgctgcgcaaccacgtgcgcctgcacacgggcgagcgcccctacaagtgccaggtgtgccagagcgcctactcgcagctggccggcctgcgcgcccaccagaagagcgcgcggcaccggccgcccagcaccgcgctgcaggcacactcgcccgcgctgcccgccccgcacgcgcacgcgcccgcgctcgccgccgccgccgccgccgccgccgccgccgccgcgcaccacctgccggccatggtgctgtgagcgcgcccgcgcccccgccgggccccgcgcgctcctgggtccccggcaccccggccccgcagcgcgactcgccctccagccccaacccccggcccggcgccgccgcggagccccgcgcgctggggttgcgccccggaggcggatctcaggcacccccgccttggcccgtgtcgcagatgaggacactgagggcggcgtccctcacccaggccacgcagctggtgcggctgttcggccgcctcctctgggagggggtccccctgcctggcctcgcccccgagtctccctgctgctgtagagccgggcgcccaggccggcatccccctcgtgggtggcaggagagcggacttagagcccccgagggcccctcagcagaggaaggggagtcccctcctccgccaccgagagtcctgtgcttcggaatgaagggagggcgacctccttgtccgggtgtggtcgggcgcgggggttgtgggggcgccatctcctcttccggcccctgggactggtgtcctgaagtgtcgggagtccttacgcaaccttgacatgtgcgggctactggggtccatcggcagcgggaagagacccggagagatgcatcttctgggcccttctctcctttaggccagcttacccccaaacctggctcctggggacggatgaggaaggagctctttgcagtgcaccaggcacgttgagagtggaggcacaatggaaatcctctgtgggaccccgagcaagaccctgcacctctttgggcctcagtttccccatctgtaaaatgaaggagttggaccaatgccccctccccttcagctgtgacatcgtgcctgggaaggcgaaatatacccccagccccttccaacacacacactccagcgagaggagggcaagactggaaccgctgcccgagaggttaaggtggcttctgtggccacgaagcgcttccgagctgtgcccagtcccgggaattccgcccagtctgcccacacttccctcggtccctgcccgtttcctcaaattcgggccgtgcgcgccctctggtgtcgcctctcacactttgcagtcatttaccaggattcccgtagggcgttttgtaaaataaactataatattaatgaaaagtataaaatgtatagagttttcaagaaactgcgttctacttccagaagatggtcactttaaccttgtaaatatttatctaaaatgatatttacaaaactgtaatatattattatttgattgtatatgtacaactgtaaatacatttgtacctctcttgtattctaaaataaaaattacttggaacatt

SEQ ID NO: 168548 - DNA, 3232 bp, Homo sapiens
  Payload ID: 13178
  Gene Symbol: PRDM13
  Gene Name: PR domain containing 13
  ENST ID: ENST00000369214
  CDS Start-End: 262-627
ccatgtgaccctctcgggtgggactctgcagctgcttcgcagcgcaactctctcaccaaactccgcgcccttgcgctagcggtgccaaaaggctcccgccccgattgaaaaggcgcagtgcatgcccgcccgcgtcactccgcgggcggaggacgcacgtcggggcgcggctctctggctagcgcgcagctccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtattgaccattcagacctctgcccactgtgcgcatggtgagaggggagctggtggacgagtcggggggctcccctctggagtggatagggttaatccgggcagccagaaactcccaggaacagactctggaagctattgcagacttacccggaggacagatcttctaccgagcattgcgagacgtccagccaggggaggagctgacagtgtggtattctaactccttggctcagtggttcgacatccccaccacagcgactccgactcacgacgagaaaggggaggagcgctacatctgctggtactgctggaggacgtttagataccccaacagccttaaggcacacctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacagagaggagtcgagggtttattctcgcagtagaggaactcctggtggtgggaagagggacccaatggacaaaaccgtttttgtttttgagagggcgccagatttgaaacagtgagaggtcccacatctggtgctgaaactcagagcaacagttcagaggtggcgtaaatctggccacctggagagctcgagtgccaccagtacctccgcaccccgggcctctggacttcttggatgagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcattgcataggcaaaacactagtcacaattgggtagatgtgacatccatatacttgtttacattttatctgttctcatgtcaaagactactccttgccccattgaatatatagtggtagcaggtgtacaaattggtcaagttgcaattatttatgagaaaataatgataaatgtaaaatatctaaagcatgaatctaagagcacgcaatatataattttaaagaaaatattctatttggtagaatacaaatgtggtgtgtgttgttttataatgactgctgtacagtgggtatagtattttggttttggttccagattgtgcaatctttaagaaaaataaagatacaaacgagagttttgttcacttagt

SEQ ID NO: 168549 - DNA, 2429 bp, Homo sapiens
  Payload ID: 13178
  Gene Symbol: PRDM13
  Gene Name: PR domain containing 13
  Uniprot ID: Q9H4Q3
  ENST ID: ENST00000369215
  CDS Start-End: 306-2429
gccattcagcggcctcgattatgcagggggctgagggaaccactccatgtgaccctctcgggtgggactctgcagctgcttcgcagcgcaactctctcaccaaactccgcgcccttgcgctagcggtgccaaaaggctcccgccccgattgaaaaggcgcagtgcatgcccgcccgcgtcactccgcgggcggaggacgcacgtcggggcgcggctctctggctagcgcgcagctccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtgcgcatggtgagaggggagctggtggacgagtcggggggctcccctctggagtggatagggttaatccgggcagccagaaactcccaggaacagactctggaagctattgcagacttacccggaggacagatcttctaccgagcattgcgagacgtccagccaggggaggagctgacagtgtggtattctaactccttggctcagtggttcgacatccccaccacagcgactccgactcacgacgagaaaggggaggagcgctacatctgctggtactgctggaggacgtttagataccccaacagccttaaggcacacctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaa

SEQ ID NO: 168550 - DNA, 2344 bp, Homo sapiens
  Payload ID: 13179
  Gene Symbol: PRDM14
  Gene Name: PR domain containing 14
  Uniprot ID: Q9GZV8
  ENST ID: ENST00000276594
  CDS Start-End: 203-1918
aattccctaccctcgacctgtcgatgccccgcggccccgcccgccctcttaagcctggctcagccctcagggcccgcccgaagtctaccgagcccgagtggcctaccgagcccgagtggccccgcagcgtccaggaggcgcccgctccgcggtggcgctcttggaggtggtgtcggagagccgccgagcgtgcggtcccgggatggctctaccccggccaagtgaggccgtgcctcaggacaaggtgtgctacccgccggagagcagcccgcagaacctggccgcgtactacacgcctttcccgtcctatggacactacagaaacagcctggccaccgtggaggaagacttccaacctttccggcagctggaggccgcagcgtctgctgcccccgccatgccccccttccccttccggatggcgcctcccttgctgagcccgggtctgggcctacagagggagcctctctacgatctgccctggtacagcaagctgccaccgtggtacccaattccccacgtccccagggaagtgccgcccttcctgagcagcagccacgagtacgcgggtgccagcagtgaagatctgggccaccaaatcattggtggcgacaacgagagtggcccgtgttgtggacctgacactttaattccaccgccccctgcggatgcttctctgttacctgaggggctgaggacctcccagttattaccttgctcacccagcaagcagtcagaggatggtcccaaaccctccaaccaagaagggaagtcccctgctcggttccagttcacggaggaggacctgcacttcgttctgtacggggtcactcccagcctggagcacccagccagcctgcaccatgcgatttcaggcctcctggtccccccagacagctctggatctgattctcttcctcaaactctggataaagactcccttcaacttccagaaggtctatgcctcatgcagacggtgtttggtgaagtcccacattttggtgtgttctgcagtagttttatcgccaaaggagtcaggtttgggccctttcaaggtaaagtggtcaatgccagtgaagtgaagacctacggagacaattctgtgatgtgggagatctttgaagatggtcatttgagccactttatagatggaaaaggaggtacggggaactggatgtcctatgtcaactgtgcccgcttccccaaggagcagaacctagttgctgtgcagtgtcaagggcatatattttatgagagctgcaaagagatccatcagaaccaagagctccttgtgtggtatggagactgctatgagaaatttctggatattcctgtgagccttcaggtcacagagccggggaagcagccatctgggccctctgaagagtctgcagaaggctacagatgtgaaagatgtgggaaggtatttacctacaaatattacagagataagcacctcaagtacaccccctgtgtggacaagggcgataggaaatttccctgttctctctgcaaacgatcctttgagaagcgggaccggcttcggatccacattcttcatgttcatgagaagcaccggcctcacaagtgttctacatgtgggaaatgtttctctcaatcttccagcctaaacaaacacatgcgagtccactctggagacagaccataccagtgtgtgtattgtactaagaggttcacagcctccagcatactccgcacacacatcaggcagcactccggggagaagcccttcaaatgcaagtactgtggtaaatcttttgcatcccatgctgcccatgacagccatgtccggcgttcacacaaggaggatgatggctgctcatgcagcatctgtgggaaaatcttctcagatcaagaaacattctactcccacatgaagtttcatgaagactactagccctgccaggcacaatgactcacgcctgtaatcccagcactttgggaggcagaggtgggtggatcactcaagtccaggagttcgagaccagcctgggcaacatggtgaaatcctgtctctaccaaaaaaatacaaaaatcagctgggggtggtggcacatgcctgtggttccagccactcaggaggtcgaggtggcaggatggtttgagcacaggagacggaggttgctgtgagctgagatcgccccactgcttttcaacctgggtgacagaaccagaccctgtctcaaaacaaaacaaaacaaaaaaaatgagtagccctcaagagtgtggagacaatgtaaaaacaagagattcggattctctctatttccttttatgggttatagaagtccctgcagttggctgtgtgtggtggctcacgcct

SEQ ID NO: 168551 - DNA, 422 bp, Homo sapiens
  Payload ID: 13179
  Gene Symbol: PRDM14
  Gene Name: PR domain containing 14
  ENST ID: ENST00000426346
  CDS Start-End: 124-422
acgccgccttcgggcaggctgggatcttccgaactgggagcggagagtaaggggctcgaccccgggacgcgagtccggccttctggactccggttcaggagccgccgagcgtgcggtcccgggatggctctaccccggccaagtgaggccgtgcctcaggacaaggtgtgctacccgccggagagcagcccgcagaacctggccgcgtactacacgcctttcccgtcctatggacactacagaaacagcctggccaccgtggaggaagacttccaacctttccggcagctggaggccgcagcgtctgctgcccccgccatgccccccttccccttccggatggcgcctcccttgctgagcccgggtctgggcctacagagggagcctctctacgatctgccctggtacagcaagctgccacc

SEQ ID NO: 168552 - DNA, 4881 bp, Homo sapiens
  Payload ID: 13180
  Gene Symbol: PRDM15
  Gene Name: PR domain containing 15
  Uniprot ID: P57071
  ENST ID: ENST00000269844
  CDS Start-End: 112-4635
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggca

SEQ ID NO: 168553 - DNA, 6654 bp, Homo sapiens
  Payload ID: 13180
  Gene Symbol: PRDM15
  Gene Name: PR domain containing 15
  Uniprot ID: P57071
  ENST ID: ENST00000398548
  CDS Start-End: 103-3639
gtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 168554 - DNA, 6542 bp, Homo sapiens
  Payload ID: 13180
  Gene Symbol: PRDM15
  Gene Name: PR domain containing 15
  ENST ID: ENST00000441787
  CDS Start-End: 214-1650
gtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaaacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 168555 - DNA, 4928 bp, Homo sapiens
  Payload ID: 13180
  Gene Symbol: PRDM15
  Gene Name: PR domain containing 15
  ENST ID: ENST00000447207
  CDS Start-End: 16-3441
tgacaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttc

SEQ ID NO: 168556 - DNA, 6662 bp, Homo sapiens
  Payload ID: 13180
  Gene Symbol: PRDM15
  Gene Name: PR domain containing 15
  Uniprot ID: P57071
  ENST ID: ENST00000449395
  CDS Start-End: 103-1770
gtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacaggactcatagcacaccctggagagggggggcccggcggcagtcggcttagagacctaccagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 168557 - DNA, 6714 bp, Homo sapiens
  Payload ID: 13180
  Gene Symbol: PRDM15
  Gene Name: PR domain containing 15
  Uniprot ID: P57071
  ENST ID: ENST00000422911
  CDS Start-End: 103-3699
gtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacaggactcatagcacaccctggagagggggggcccggcggcagtcggcttagagacctaccagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 168558 - DNA, 6124 bp, Homo sapiens
  Payload ID: 13180
  Gene Symbol: PRDM15
  Gene Name: PR domain containing 15
  Uniprot ID: P57071
  ENST ID: ENST00000433067
  CDS Start-End: 112-4635
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 168559 - DNA, 4992 bp, Homo sapiens
  Payload ID: 13180
  Gene Symbol: PRDM15
  Gene Name: PR domain containing 15
  ENST ID: ENST00000447016
  CDS Start-End: 78-3503
gttcccaagcagtgctggcactgctggttcctggtccagggaccacattttgaaatcactaatgtaaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 168560 - DNA, 8690 bp, Homo sapiens
  Payload ID: 13181
  Gene Symbol: PRDM16
  Gene Name: PR domain containing 16
  Uniprot ID: Q9HAZ2
  ENST ID: ENST00000270722
  CDS Start-End: 50-3880
gctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagcagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgtgtggacatctcctcaggctttgtgtcacgcgtggacatctcctcaggctgtccccagcggtgacgggaggtgtcctggctgctccaggacaaaagacaatcgtctctgtgggtgccgggtggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccgccggggcagcgggggagctgcctgcagaagagccagctggcgtgtcgggaaggatccaggatctgcaaacacaactgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttttgcaatatgaccccgtctctctgaagtgggacattcggacggatggagccctcagcgtgtcttttcagcaggagcagaaccgatgagagccgcccttaccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccatgagcgtctgcaaaacacttgcctgaatacatatcacgtattttagactcgaagcctcaaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagttttgttttgttttgttttttcttttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttctaa

SEQ ID NO: 168561 - DNA, 5447 bp, Homo sapiens
  Payload ID: 13181
  Gene Symbol: PRDM16
  Gene Name: PR domain containing 16
  Uniprot ID: Q9HAZ2
  ENST ID: ENST00000378391
  CDS Start-End: 64-3837
gaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagcagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtccccccca

SEQ ID NO: 168562 - DNA, 4236 bp, Homo sapiens
  Payload ID: 13181
  Gene Symbol: PRDM16
  Gene Name: PR domain containing 16
  ENST ID: ENST00000514189
  CDS Start-End: 50-3583
gctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagcagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaat

SEQ ID NO: 168563 - DNA, 3737 bp, Homo sapiens
  Payload ID: 13181
  Gene Symbol: PRDM16
  Gene Name: PR domain containing 16
  ENST ID: ENST00000509860
  CDS Start-End: 1-3255
atttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtgg

SEQ ID NO: 168564 - DNA, 4282 bp, Homo sapiens
  Payload ID: 13181
  Gene Symbol: PRDM16
  Gene Name: PR domain containing 16
  ENST ID: ENST00000511072
  CDS Start-End: 93-3629
ggtgtccaaactgacaatgctggggagatgaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagcagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagcagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaat

SEQ ID NO: 168565 - DNA, 384 bp, Homo sapiens
  Payload ID: 13181
  Gene Symbol: PRDM16
  Gene Name: PR domain containing 16
  ENST ID: ENST00000463591
  CDS Start-End: 1-162
acaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatgaaagtgaaattggagtgaaggaaaattgggcttgaggcgcatagaaggacggtctttccgtccccttctggggctcagatttgcagagtgtgtccttagtcgtccgttgggaagctgacgggcaggggcaccgcggggctgggccagggctgtgcttttgtgagatgcaaactatagtaatgaagggcccagattttttttatttaagaaataaatgtttattagaacttttgaactaaa

SEQ ID NO: 168566 - DNA, 7957 bp, Homo sapiens
  Payload ID: 13182
  Gene Symbol: PRDM2
  Gene Name: PR domain containing 2, with ZNF domain
  Uniprot ID: Q13029
  ENST ID: ENST00000235372
  CDS Start-End: 857-6013
gtaaaagtgacattctaaatgttcctcactctgcgaggcttattttttagggactttgctataattctgaaagacttagttttacagtacatctgaaagtaggagttttcagaagtatggctcttgggataaatttagattcttaattgtgaagctctgttaccacttgttagaaggcaggtcagctcacctgcttggggaggtaaatatatgaatgcactctcgagtaatttaatggagccctacctcaatgtacagaatgacagtatcacagatcaagaatggagtacgagtgattttcggctatggtgggggtaggtaggtcacttgtcccctgttgtctcttactatttgtaaagtgaagactatgattagtctttttgatcgggatggtttgagatgaataaagaataggcaggcaatttggatactttaggcttttcaagaacattagtaacattttttcttagatatttctcctaatacaatgagtgttgtgaaataacatggcagttattgttgagagaaaagccttcccagttatgtattgagtccttaggcgttttgaccttccctccactcttacagaacttggtggaaggggccactatgttttctacctccttccgtgcctttcacaaagccacatcctgcaccgtctacccttctctgtggatatttttccgcttggcaatttcctttcctgaggcacccacttgggacatctgaatctccatctccatgttgatggcccgtttgtgcttggacgtgttcttccacttgagactgagggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcagctacagcctccgcttggcgtcccgatgctctccaccagcggccccgtacatcaccaggcagtataggaaggtcaaagctccagctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgatccccggggcggcaggaagggggccgactccacgctgtcctttgggatgatacttggatgcagctcttgggaccgtgttctgcagcccagccttcctgttggggtggggcctctcctactatgcaatttttcaagagctccttgaccctgctttttgcttcttgagttgtcttttgccattatggggactttggtttgacccaggggtcagccttaggaaggccttcaggaggaggccgagttccccttcagtaccacccctctctccccaccttccctctcccggcaacatctctgggaatcaacagcatattgacacgttggagccgagcctgaacatgcccctcggccccagcacatggaaaacccccttccttgcctaaggtgtctgagtttctggctcttgaggcatttccagacttgaaattctcatcagtccattgctcttgagtctttgcagagaacctcagatcaggtgcacctgggagaaagactttgtccccacttacagatctatctcctcccttgggaagggcagggaatggggacggtgtatggaggggagggatctcctgcgcccttcattgccacacttggtgggaccatgaacatctttagtgtctgagcttctcaaattagctgcaataggaaaaaaacaaattgggaaatgaaaaaaaaatgggaagattaaaaagcacagggggaagaagaagagatttcggaggccatcctgccaggggcggacggggctgactcctgctctctggaggacggtcagtccatgtctcggagaaacgggtgagctgagcttggcgtttggacccagttcagtgaggttcttgggttttgtgcctttggggcagaccccaggcaaggatgtctgagaccacttgggcgctgttttctcagctccaatttcaagagtgagctatcaaacccagagcggaaggagggagctctgatgagcacggtttgtcacacgataaagggattttttttttcagggctactacggttgatcttgcaactctgtaaatatgtatgtagacacttttaaaagcacgtatttatgtccctgactgtaaatgctccatttttaaagttttataacttgtgttatttaatgagtcagtcaatcggctgcagtatgggatctgataaggatctaggagaagggtctcatgcggaccctcacatgggcagaaaaatggtggtcattggccgacatcacagttttcctgtttcccacccagctaaaaaccgttgtttgctttaaattttcataaactggaatcctttcacccgctcctacagctaaccctcacaagcatgaagtgctgtggctgttccttatcctaatgatgcgcttttgtcccgtaaatgttaacactcatgaagcataccccggcctctcagttcttgagggcctccccaccgcagcagcaaggaaagctcacgaaccccaaacctggcaagtcacctgcagcccatggtgagctctgggaagtgtggttgaggccttggggtcactccttttttgcatgtgcaaatgtgctggtcacccttcaacgctcccagacggtcaggaaaactgttccaatcatgaaaaggggggatgattttgtaaaagtggcatttcctggtcagtggtggtcttcaagacgacagctctgtatctgccatgtgaagagaattaacaataaaagtgtgaagagcgattgtgaggaacaa

SEQ ID NO: 168567 - DNA, 7437 bp, Homo sapiens
  Payload ID: 13182
  Gene Symbol: PRDM2
  Gene Name: PR domain containing 2, with ZNF domain
  Uniprot ID: Q13029
  ENST ID: ENST00000311066
  CDS Start-End: 857-5905
gtaaaagtgacattctaaatgttcctcactctgcgaggcttattttttagggactttgctataattctgaaagacttagttttacagtacatctgaaagtaggagttttcagaagtatggctcttgggataaatttagattcttaattgtgaagctctgttaccacttgttagaaggcaggtcagctcacctgcttggggaggtaaatatatgaatgcactctcgagtaatttaatggagccctacctcaatgtacagaatgacagtatcacagatcaagaatggagtacgagtgattttcggctatggtgggggtaggtaggtcacttgtcccctgttgtctcttactatttgtaaagtgaagactatgattagtctttttgatcgggatggtttgagatgaataaagaataggcaggcaatttggatactttaggcttttcaagaacattagtaacattttttcttagatatttctcctaatacaatgagtgttgtgaaataacatggcagttattgttgagagaaaagccttcccagttatgtattgagtccttaggcgttttgaccttccctccactcttacagaacttggtggaaggggccactatgttttctacctccttccgtgcctttcacaaagccacatcctgcaccgtctacccttctctgtggatatttttccgcttggcaatttcctttcctgaggcacccacttgggacatctgaatctccatctccatgttgatggcccgtttgtgcttggacgtgttcttccacttgagactgagggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaacc

SEQ ID NO: 168568 - DNA, 5797 bp, Homo sapiens
  Payload ID: 13182
  Gene Symbol: PRDM2
  Gene Name: PR domain containing 2, with ZNF domain
  Uniprot ID: Q13029
  ENST ID: ENST00000343137
  CDS Start-End: 222-4667
gagatagcagctgcgattgaggaagagcgagccagcgcccggagcaagcggagctcccccaagagccggaaagaccaagcggagcagccagctggcagtagcgccctgtaggacccccaggacccgatgggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaatta

SEQ ID NO: 168569 - DNA, 2688 bp, Homo sapiens
  Payload ID: 13182
  Gene Symbol: PRDM2
  Gene Name: PR domain containing 2, with ZNF domain
  Uniprot ID: Q13029
  ENST ID: ENST00000376048
  CDS Start-End: 127-807
gcgaaacagcggcggcggcggcggccctcggtgctctgaggcgctggcgcggcgggcgcggggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagctacagcctccgcttggcgtcccgatgctctccaccagcggccccgtacatcaccaggcagtataggaaggtcaaagctccagctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgatccccggggcggcaggaagggggccgactccacgctgtcctttgggatgatacttggatgcagctcttgggaccgtgttctgcagcccagccttcctgttggggtggggcctctcctactatgcaatttttcaagagctccttgaccctgctttttgcttcttgagttgtcttttgccattatggggactttggtttgacccaggggtcagccttaggaaggccttcaggaggaggccgagttccccttcagtaccacccctctctccccaccttccctctcccggcaacatctctgggaatcaacagcatattgacacgttggagccgagcctgaacatgcccctcggccccagcacatggaaaacccccttccttgcctaaggtgtctgagtttctggctcttgaggcatttccagacttgaaattctcatcagtccattgctcttgagtctttgcagagaacctcagatcaggtgcacctgggagaaagactttgtccccacttacagatctatctcctcccttgggaagggcagggaatggggacggtgtatggaggggagggatctcctgcgcccttcattgccacacttggtgggaccatgaacatctttagtgtctgagcttctcaaattagctgcaataggaaaaaaacaaattgggaaatgaaaaaaaaatgggaagattaaaaagcacagggggaagaagaagagatttcggaggccatcctgccaggggcggacggggctgactcctgctctctggaggacggtcagtccatgtctcggagaaacgggtgagctgagcttggcgtttggacccagttcagtgaggttcttgggttttgtgcctttggggcagaccccaggcaaggatgtctgagaccacttgggcgctgttttctcagctccaatttcaagagtgagctatcaaacccagagcggaaggagggagctctgatgagcacggtttgtcacacgataaagggattttttttttcagggctactacggttgatcttgcaactctgtaaatatgtatgtagacacttttaaaagcacgtatttatgtccctgactgtaaatgctccatttttaaagttttataacttgtgttatttaatgagtcagtcaatcggctgcagtatgggatctgataaggatctaggagaagggtctcatgcggaccctcacatgggcagaaaaatggtggtcattggccgacatcacagttttcctgtttcccacccagctaaaaaccgttgtttgctttaaattttcataaactggaatcctttcacccgctcctacagctaaccctcacaagcatgaagtgctgtggctgttccttatcctaatgatgcgcttttgtcccgtaaatgttaacactcatgaagcataccccggcctctcagttcttgagggcctccccaccgcagcagcaaggaaagctcacgaaccccaaacctggcaagtcacctgcagcccatggtgagctctgggaagtgtggttgaggccttggggtcactccttttttgcatgtgcaaatgtgctggtcacccttcaacgctcccagacggtcaggaaaactgttccaatcatgaaaaggggggatgattttgtaaaagtggcatttcctggtcagtggtggtcttcaagacgacagctctgtatctgccatgtgaagagaattaacaataaaagtgtgaagagcg

SEQ ID NO: 168570 - DNA, 513 bp, Homo sapiens
  Payload ID: 13182
  Gene Symbol: PRDM2
  Gene Name: PR domain containing 2, with ZNF domain
  ENST ID: ENST00000407521
  CDS Start-End: 280-513
gaagagcgagccagcgcccggagcaagcggagctcccccaagagccggaaagtgttgtcctgtccctctgctgttccttgtcatcatttccatttcacttcccttgtgtttcattcctctttcttgtctagaccaagcggagcagccagctggcagtagcgccctgtaggacccccaggacccgatgggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaa

SEQ ID NO: 168571 - DNA, 6175 bp, Homo sapiens
  Payload ID: 13182
  Gene Symbol: PRDM2
  Gene Name: PR domain containing 2, with ZNF domain
  Uniprot ID: Q13029
  ENST ID: ENST00000413440
  CDS Start-End: 178-4623
gaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaaaca

SEQ ID NO: 168572 - DNA, 628 bp, Homo sapiens
  Payload ID: 13182
  Gene Symbol: PRDM2
  Gene Name: PR domain containing 2, with ZNF domain
  ENST ID: ENST00000484063
  CDS Start-End: 169-628
ggagtcaagatggcggcggcgcggccgcgggcgccggggccggcgaaacagcggcggcggcggcggccctcggtgctctgaggcgctggcgcggcgggcgcggggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagc

SEQ ID NO: 168573 - DNA, 1100 bp, Homo sapiens
  Payload ID: 13182
  Gene Symbol: PRDM2
  Gene Name: PR domain containing 2, with ZNF domain
  ENST ID: ENST00000491134
  CDS Start-End: 1-135
gcggccaccgagaccctggctgaggtacccgaacatgtgctgcgaggacttccggaggaagtgaggcttttcccttctgctgttgacaagacccggattggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagaccaagcggagcagccagctggcagtagcgccctgtaggacccccaggacccgatgggaagaaaaaatcccaggaaaataaaaacaaaggaaacaaaatccaagacatacaactgaagacaagtgagccagatttcacctctgcaaatatgagagattctgcagaaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgtttt

SEQ ID NO: 168574 - DNA, 705 bp, Homo sapiens
  Payload ID: 13182
  Gene Symbol: PRDM2
  Gene Name: PR domain containing 2, with ZNF domain
  ENST ID: ENST00000503842
  CDS Start-End: 202-390
ggaagagcgagccagcgcccggagcaagcggagctcccccaagagccggaaagaccaagcggagcagccagctggcagtagcgccctgtaggacccccaggacccgatgggaagaaaaaatcccaggaaaataaaaacaaaggaaacaaaatccaagacatacaactgaagacaagtgagccagatttcacctctgcaaatatgagagattctgcagaagctacagcctccgcttggcgtcccgatgctctccaccagcggccccgtacatcaccaggcagtataggaaggtcaaagctccagctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgatccccggggcggcaggaagggggccgactccacgctgtcctttgggatgatacttggatgcagctcttgggaccgtgttctgcagcccagccttcctgttggggtggggcctctcctactatgcaatttttcaagagctccttgaccctgc

SEQ ID NO: 168575 - DNA, 568 bp, Homo sapiens
  Payload ID: 13182
  Gene Symbol: PRDM2
  Gene Name: PR domain containing 2, with ZNF domain
  ENST ID: ENST00000505823
  CDS Start-End: 145-333
gaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaagctacagcctccgcttggcgtcccgatgctctccaccagcggccccgtacatcaccaggcagtataggaaggtcaaagctccagctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgatccccggggcggcaggaagggggccgactccacgctgtcctttgggatgatacttggatgcagctcttggg

SEQ ID NO: 168576 - DNA, 646 bp, Homo sapiens
  Payload ID: 13182
  Gene Symbol: PRDM2
  Gene Name: PR domain containing 2, with ZNF domain
  ENST ID: ENST00000487453
  CDS Start-End: 582-646
tctcaaaaacaaagaaaaaaaaaggtgtttaaaatggtattttagaatttacgttttaagactaacaagcaaaatgactgttaaggttatgtctcaaatttttgtcaaaatctggtggtgttttttaggatttgtttttgctttgtattgtatttgatgtttctacttttaatctagatgttttcaatgatgctattttatgtctctgacctcatttttgtctgtttacatttttagctaattatgcttcccggtagtgattctctgttatggagtatgtaactttacgtgtatatagcagctttaagtcgtttttagtttgattttactaatgcagagataaaaggtgtcagaggcttgtagttctggaagctggtggaggtttgtctgggggagagcagcggagaaaaaggaggattgttacggaagaatggggatctgtctggatctgaagactgaaacaccagcttccagaaaaatagaaatctgggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagca

SEQ ID NO: 168577 - DNA, 4210 bp, Homo sapiens
  Payload ID: 13183
  Gene Symbol: PRDM4
  Gene Name: PR domain containing 4
  Uniprot ID: Q9UKN5
  ENST ID: ENST00000228437
  CDS Start-End: 461-2866
ggctgaggatccggaaacgcgccgcagagggtgcggcccagaggaggccgcgggccgggaagggccgggcgggacgggaaacgttagggcagcggcccccggggtgagggggccgagcggacgggcagggccccgaggcgaactctgcccggatgaggaacaaagcagtggggcaggcgcgtgcgcccccagcgcagctggcaggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattttggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacagga

SEQ ID NO: 168578 - DNA, 2591 bp, Homo sapiens
  Payload ID: 13183
  Gene Symbol: PRDM4
  Gene Name: PR domain containing 4
  ENST ID: ENST00000550376
  CDS Start-End: 399-1349
acgcgcggaggggcctgggctgggagaagggcgacgcggtgcgcgggcgccgcttgcgggccgcggcggggagggcgcacgcacgaggggcggagcggcgggcgctgagagtggctgaggatccggaaacgcgccgcagagggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaa

SEQ ID NO: 168579 - DNA, 640 bp, Homo sapiens
  Payload ID: 13183
  Gene Symbol: PRDM4
  Gene Name: PR domain containing 4
  ENST ID: ENST00000547188
  CDS Start-End: 414-640
ggggcggggcgcggcggcccggcctgcgggccgcgggcgggctaatccacagcccttgggtggcggtgtcggcagcgcctggggctttcgggtagctgggatgggggctgcgaccttgttgtggttttggtgaccgctcttgtccccactcccccaggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtat

SEQ ID NO: 168580 - DNA, 837 bp, Homo sapiens
  Payload ID: 13183
  Gene Symbol: PRDM4
  Gene Name: PR domain containing 4
  ENST ID: ENST00000550659
  CDS Start-End: 1-837
cccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttgttggtgtccttccactgacaggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttat

SEQ ID NO: 168581 - DNA, 5330 bp, Homo sapiens
  Payload ID: 13184
  Gene Symbol: PRDM5
  Gene Name: PR domain containing 5
  Uniprot ID: Q9NQX1
  ENST ID: ENST00000264808
  CDS Start-End: 242-2134
gcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacatgttcttcagtgcacagcgaaaagcagtctaaaggagtcttcgcgaagttttcagtgctctgtttgcaattcttccttcagttcagcatcgagttttgagcagcaccaggagacttgccggggggatgccaggtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggccatccctctgtaatgaagtttataatatacttccctaataggcctttttattttattgttattctttgtgtgtctgtgtgtctgtgtgtctgtatgtgtctgtgtgtgtgcactcacttgcaaatgccagttgttgcagctggttttaccaatttaaatagaaataaatcaagatatccaactatttctttgcagatgaggataagaataagttatcaaagtctcaagtttgataggaaaataaatagttgctattttataagacaaaccaagagctgagcttatctaatagctctgtgcaacaaatgagtttaaaatagatatttgataactaaaacatctattaaaatattgctcattttagaggattcttaggaaacattatttattctcatcattcagatgcagacattcatggtctggaatacttttataagttctacacaaaaatgaccatcacatttaaatattcagcaggctacccctcttgaatttagaccatttagctttagaaattaacagtataccaatatatataattaaaaatagaaaccaaatagattctctgtatttggcaacagagtggcagaacaatagtggcatctccacatttgttaggatgaacatagccctttcccctctccttccataaaagtgcacagaacatgttagtgcagatacagtcctcagaacattaacattccattttgcaaaagacattttccagaatcttggcagtaggtaattctgaaacacttttgaattaccttcaatcatcccatataattaggaatccagaatacaaagtacaaacttggcaattgttatgattgaaactgtcactgatgcttaagggaaattgaagcaagaagcataatttcttcctttaggttatatttcagcaaaatacttgacagcaacatacaatgaacagcttgtttggagagatgatatgatacaatgtaatagtgatgtcaaaataacctggaggaatatccaaaaaccagaaaaacgttaaaatgaagcccaactcatgaacctctctaactgaagcccagtcaaaagaaaggaagtatagttttaaggaagttatttggttctaatgagttaaggagaaaggttatctgagacacagttctttgacttcaggaatctcattttagaattatattcatgcccagttccagttttaaaaagaaacataaagattcaatgtagacatttgaatgttgtaaaatactaaatttgaaactcagaagagataacttttaaaaacataaatcctaaaattatagtttagaagatatttaagtatagttatatgtagtattttgaatctgaaattatagactgtattttataaaaataaattttggtcttgtttctcactatatcatttgtttcaacaatatatttttagatctaaagtgttttcattttaatatgatagtgtgtttaatatcatttgaatataaaaagacagctgtaaaatttgatagtgtgtattatttaagcacatcctgtatatttctttgaatgctgctttctctatatgggatgctttatatcccgattatgtgatgaatgtaaaacttgaaaggagtccaaattccaattttgtgtaatctcagtgagtcacagttcacatggctgctggggaaattaccctgaaaactgtggtgtcgctatgctgtggagtaaacagacaggcaagaggtgctgggctttatcctgctgaaggtttatagacatggaaatctttagaaaatggtgtagaaggacctacaccagagagtggtacaccactctctcctttcagaggactgaaaccaaaacaagtccttagtagactatttgtatgctgtaaatttttatccaaaagacaagtattcatgggtagtttcagatatattagcatttgcttgctaaaacttttaaattacttagtaataaccaaaaaaagacactattttaggcatgattgatcaattgaaagcatagataatcataaggaaaagtcttacagacaagctgaagtacaggtacctactttgaaatgtcttctgtttcctgctgtgaaagattttggctggggtattttcttgagaaaagaccagacccttaggtgcctataaagtctaagtaattgagacttagaaattggctaagtaaatttaagagacgttcaataatgtaggtgggttcagatacccttttataataactgtcttcttagtatattaacactcaagatgtttgtgtatctttaatttgcctttgtttcacaataactggcttttgttttccttttcatggtgtgttgttggctatatagaggcatttattggtaaattataatcagcagttgcaccatggaagtattcttggtgataaattcttggggttacatagtatagttaacatgttattttcaagaaacatgagtgtgtgtgtctgtgtgtgtgtgtctgaagagtatcacttatatgcagtgcatatacatgtaagtgcattactttgctcaaatatcttctgacctattacagtcaactcatgcatgagtgtgaacatgtattacagaaggtcttacagccttagtttctgttttagattttatgtgctgcttcctttctcaaacaaaagcatgaaaggaaagaggataagtactagaaatattcatttttttccttcacaaatctaaatgttgcttatgaaaactcatcttagagtaatgaatatgtggaagtgggtaggtaggaggaaatgtgcctctttaaaatcctaaaattttaccattgatattgacatttgtttgcgtgtatataaatggagcatgtgtaaatatagaattccaatagcattttttattttattataaatctataataaatatatataaatcactacca

SEQ ID NO: 168582 - DNA, 2492 bp, Homo sapiens
  Payload ID: 13184
  Gene Symbol: PRDM5
  Gene Name: PR domain containing 5
  Uniprot ID: Q9NQX1
  ENST ID: ENST00000394435
  CDS Start-End: 263-598
gcgcccaggcccgcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagacaagaatttgggacccgccgaatggcgaggctaaaagagctgtaacacagacaagactgagacctgctccttgcttgccacattgcgagtgaagagaaggagagaagagctgcagcctttcagggatcccagacctgggagctccccaagccagggctgtgactccttctttggggtgctgcagttcctggtgtctccgagcttctggatgccactgtgttccctggtgtcagctgtggaagctacttgcggtgtgcctgtcccagctgcagcctggcagagagctggcacctgtgctggcacctggagctgcccacccttctgcagcagccggcatatctgactgtgcattggccagaccccacactcactctcacaccccttgccgctccatgcagtctcccttggcaggtgtggaatccaggccattagtgtgagctgaacacagcctgccaggtcgagtgagcagaatgagctcagtgggctgaagcaaaaatttgggcaaaggcacgactggccacagaggtttccagccagaaaagcaacaccccaaagatcccataataataggagtgcaaaacctgttgtaaactgtgcatgccagggatctaggttgtgtgttccttatgagaatctagctaatgcctggtgatctgaggtggaacagttttatcccaaaaccatccccagccccatccctgtccatggaaaaactgtcttccacaaaacctgttcctgatgccaaaaaggttgggcactgctattctataccgctgtaggatgactatagttaacaataatatatagtttcaaaaagctagaaggaagacattgaatgttcccaacacaaagaaatgatacatgtttgagatgatggatatgctgattatcttgatctgatcactatacatgatatgtattgtaacatcactaggtaccccatgaatatgtacaattatgtgtcaagataaataagtaataaaataaaaagctttatcttattccccaaaaaaagacagcttgaggaaaggaaaaaggaagattactagcagagttgtaggctattgtctatggtactttactgcatgaagaaggtacagaggctgaatggaagaggggttgtaaaactggagtatgggctttcctttcacatggagctttgtttaacagaagtctagaaagtagatataagaatcattatcatggttagtttatgtcaaaactatacatactgtcttattatacttaattaaatgggtaatcatttgactagtgtgtctatgagttcgtaagttggtacttaatggttatattatttaattcacctcagtggacagagattaaaacagagtcattttctggttccttttcctgtggttaattaagtcctttgagatatggctgtatacactttatggtggtttacacatgtctgttttattagttttgcagacagtagacaggaacaaaaaggggcatagtcattcttgctgtgagttaaccctacacttctccaagcagtagaatgtaaactcaactaggcttttgagaactttccctcagtgacttaattaattccatgcccatttctggactttggaatatagcatgcatctatgtagcttgttttttactttatcaaatttaaaatgctcattatcgaacatttatatttttatattaaacttttgtaagtataacctgcttggtttcaaatatttcacatgcaacatgacattggttggaataatgttatgttgtatgtaaaagtgtaagttgtatgtaaaagattaatatcacaatcctttgaaatactttgcaccttgctattgaataaagttgatgacttttaattctgttgacataatctagaacccatagggaaactctatgataatgttttacttctagaaagtcagtcaataagt

SEQ ID NO: 168583 - DNA, 2338 bp, Homo sapiens
  Payload ID: 13184
  Gene Symbol: PRDM5
  Gene Name: PR domain containing 5
  Uniprot ID: Q9NQX1
  ENST ID: ENST00000428209
  CDS Start-End: 251-2050
gcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacattttgagcagcaccaggagacttgccggggggatgccaggtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggcc

SEQ ID NO: 168584 - DNA, 2259 bp, Homo sapiens
  Payload ID: 13184
  Gene Symbol: PRDM5
  Gene Name: PR domain containing 5
  Uniprot ID: Q9NQX1
  ENST ID: ENST00000515109
  CDS Start-End: 258-1763
caggcccgcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacattttgagcagcaccaggagacttgccggggggatgccaggtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggcc

SEQ ID NO: 168585 - DNA, 1044 bp, Homo sapiens
  Payload ID: 13184
  Gene Symbol: PRDM5
  Gene Name: PR domain containing 5
  ENST ID: ENST00000502409
  CDS Start-End: 1-437
gaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacatgttcttcagtgcacagcgaaaagcagtctaaaggagtcttcgcgaagttttcagtgctctgtttgcaattcttccttcagttcagcatcgagttttgagcagcaccaggagacttgccggggggatgccaggtttgtgtgcaaggctgacagctgtggaaagaggctgaagagcaaggatgccctgaaaagacaccaggaaaatgtccacactgtattagtacatggaaaagtgaaaggcctgttttatatatgagaaaggtggtatatgaagctgtgaagatgtctcaaatttaaaaagaaagcatttacacagaatgggagaaaatatttgcaaactacccatctgacaagtgattaataaccagaatatataaagtgctcaaacaactcaataggaaaaaaatcaaataatctaatgaaaacatgaagaaaatatctgaatagacatttttcaaaagaagacaaatggccaacaggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccat

SEQ ID NO: 168586 - DNA, 9267 bp, Homo sapiens
  Payload ID: 13185
  Gene Symbol: PRDM6
  Gene Name: PR domain containing 6
  Uniprot ID: Q9NQX0
  ENST ID: ENST00000407847
  CDS Start-End: 415-2202
ctctctcacacacacacacacacacacacacacacacacacacacacacacacacacacacacacacacactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcagttcgaggcgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcgctgagcctccgccggacagcctgcgcccgcggcccgcctctctctcctccgcctcgtccacgccggcttcctcttccacctccgcctcctccgcctcctcctgcgctgctgcggccgctgccgccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgttgcgacatgtgcgcggacaaccgcaacggcgagtgccctatgcatgggccactgcactcgctgcgccggcttgtgggcaccagcagcgctgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggagatatatgaccaggatgggacactacagcactttattgatggtggggaacctagtaagtcgagctggatgaggtatatccgatgtgcaaggcactgcggagaacagaatctaacagtagttcagtacaggtcgaatatattctaccgagcctgtatagatatccctaggggcaccgagcttctggtgtggtacaatgacagctatacgtctttctttgggatccccttacaatgcattgcccaggatgaaaacttaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacagaccctaccaatgcggccactgctcccagtccttttcccagccttcagaactgaggaaccacgtggtcactcactctagtgaccggcctttcaagtgcggctactgtggtcgtgcctttgccggggccaccaccctcaacaaccacatccgaacccacactggagaaaagcccttcaagtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggttaacatttccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagcttaaaaaaaaaaaaagaaaatgaaaataaagttctttggtttaaggctggagataaggtgttaggcttcattgtaatttttttagttgtttctgtgaaagtgttgaacatgtgaacaaaaatagtgccaaaccccatcgtcaaggcccttttagcaattttatctttcttcctcttgcagatgaaccccaggagccccctttcctctctcctgagtgtgggaggagcatgtctacaaacacaagtgaaaatagcccagacaaggagactttgagaggaggaaccatggagaaggttgtggttagaacagatagcccaggagcagctaattttatcaataggattactttgtcttttcttgagattgattaattgaaagagaaggaattctccacacaatttcactattctttgagtgctgagaatgtgagtttaatttcagctagcctgttggtggttcaacagtggtgctcaatgaaattgggtcacatttaatgaaatgatctagttttgggaagagctgatagctcccagcagcatctcagcgactgtctaccttgatggccagtttagataaaaactgttcagttttatctagagtgtttaataacaacagtttctgtttgtaaatttcatcatcacctgatatcaggacacagtcttttaaggaactccttgtctttgagctttcccattgtcttccctcaataaaaatgagacacataactgaactcactactaaaaggcaaggatactgtgtggtttagtttaatctattattatgtatctggctctgagaaaatctctcttcccttttaattttgcttctctattccttagcaccccagctaccacattttaaatggaattcaacagggtctaattaataagtgtttacagttattatttatatacgtatatatacatatatacacataataataatctctagaaccctgggccataaagaaaaaaatggctaattctgacctctgttgcccaatctcaagccattcacctagaattttcctccagttcttactatctcctggtcatgaaagtagtaaggaatctatgctgctgtataacagtagctgattgaaactattctctctggtagttaggaatgtgttctgattttacaattccctgccctaagtgatggatacgtttgcaaacaatgtgcgtcactgggaagtgtgaatgaaatgtagccatattaacctgaaacctgcaagaaaaggacagatcagcttcacagatgagtaagctgttccatttgttaaggttgaaagatttactcaaactttttgaaaacaacagtagggaatcacctgtatatttctaattttttttttcatttgaaaaatcagctcagccatttgccacatttcacagtggaacaccatgtactactcagttctcatgagcttcagaacgtgggagaatgagaaggcttccctcctcccttgatgtctggcatgggaaggttttccttaacaatgatctctctgccaccctgatagctttgctagctgatcccaaacttccactgaatgtggcagtaacctgtactccaaaacactcttctagtgttctgctccatttaaatctatttttatcctctattattaagagaaattgttggcatatatattccaccaaatttggtcagaaaatattttctgcctaacaaatagaaaattggatactctaattttccaggcatgtgggcacattcacaatttttacattgctgtcctattgccagcttctagcagaccagcctaggctgtctgtccacaaagacaggcttacacctggacattgacttggaaccctgaagcaggtactgagatcatttgggtccaaaatgattttaatctaagtgtatgctggggaggaggtttctctttgaaacttcctaacaattgctttagccttttctatttaaagtggacacacagtcccctgggatacagcaaatgggtggtagaaattgcagtcgtaaaatttgccagtttttcttattagtaacttcctaattagtagtgctataaagagagtaaatgctctgaatcactggggaaaggatatttaagataagaaaggtagtctgtcagagctgaatcagggtttggctcttgaagcaatccttctttactcttttctttcaatggggataaaataataataattttttcagaataagacttttcatcctagcgtatgttcctttatttagcagagtctaagacgaaaggtaatgccagggaaaagtcagggtgcaataggatgagagatggagctgcagacctttgcatttctagaaaaatctcaatatcccaaggcaaagttgtattttccccaggatatgtgcatacatttttcatagataagcttttcatttttgttttgtttttatctttaaaaatgacttttttggaggagatatacttctaaaaagttattgtatggctaattaaagctatgaaacttaatctcatataatttatataatttgattcagttggtacattttttattgtgttcatttaaatgtagccttcttgggaaactatgtataacaggaaaagatcatgacatcattgtgtcctcatagggctcataattgaattttaccttgtaaaaatttcattctggttcaggtatgcaaagatttatacgaacatttagcagttcatcaatttttaaatcagatgttcattgtttcattcatttattcaacaagtatttattgaactcttattttatataaagaccccattttatgtgttcaccataagcagcattatttaagtgactattcatgataaaataatattctcctcctaagtggctgctagtaaaatgggtattttagtcctttagaccattgtctcagtgaagttaaagattttgttccaactgggaaaatctgagagaggtaaattcatctggggaccagaaaatagcatattgcaaaacaagttaagatgcacaacttggttgtctttgcttaactcactgggctattggttgttagcagcagtatcaagagaccaggattagggcctgggtcttgggtttttatgaccccccctttcaatgataaggcaacaagttgggtacaaggctggagttgctcagggaaggagatctgcgaccctgaatgggtcagagttgcctcattagtggtaagcgttggcagtgtagtccctttccccggtgtgcagaagtaacattatttgttttgcactaatttaaaatttaaaatgcaagtatctattgagttgtttaaaatgggaatcatggcacgtctcacaaagagggcatttccagaacagcagggttaacgggtccctctgagtgtacccagcagcctgcgtttaggagcaaattcattgctctcatattaaggctatgcatgcctacagaaaccaggccaggaataagaaataaataatcacatttcctgaaatgtttatctgtttcttccttgacatgaatttaatttttatttcccagagtctttactagatcctgacatcagattttaaaagatactgagatatatgcttctttaaatgataactgtaagttccagaaatgttattcacttgtcaggatccttttaaggtgaagagctttggaaaattttatgcgctaactagatacctgggtgatcatcaacccaaagtttaaagttctcccctcactagcatttatctgaactaccacaaaacaacaacgcaggttactaggaaggcacctatttcagccctccccaagattgcattctacaaacccagagatcagctgtcaggtacaactggccagacagagccaaactgaaaagaatattgctttatctgtggaaaccttgccacagatgtttaacctgtagtccatggctgtgtttgacatttaaaatatttatttagtttcttcctttaaataataaatgccagatgtttcatcagatcaatatgtaaaacgataacaaaaaatatgtcggaaacaggtcaaagtcatgaaacatttgaattgtctttcctatagactgaatatgccaccactgcacttagaaaacctatggaggaaattttaatggaaaaataaggacattctgcgcttattcccacagaggttgatgggaatgatgatgattataaattatattgtgcaattactgccatgccttgttctaatgcttaatgtggattatctcttttaatccttagtaactctataacaaagatactatcattatccccttctcatatatgcttaacagttttagctttgtagcttctttagtttttttcctccttcaaagccataaacaggcaattgttaaaagaggaaaatacttctctatgtaaagcttttttttgagaacaagagcttttaaaaattaataaacacaagtataatttatttataaaatgtgtttgtggaaacaatactgaagtgctattaaaacacgtatcattatagatgctgattttgtcatgcccaaatctcattgctggacagaatttcaactattccattgctgtcaggcattgtttttgtttttctaagcaggaatctaaaattccacattgaaagaaaaaaaaataaccctctcaagtgtgatatacattaggacaaatggcaacaggcaggaagggcaggttgtgttggagggtggccagaagagaataaggttcgaacactatcgacaggtaaaaacacatcctcaacggggctaagtgaaatctcgttttctttctttgttctgactgaatgctaagtgagttactttccaggcatcaatggagtcattacgcagttgtgtgcattaagaatatgggcttatgttgttagcctgttggtttaaagcagtgcagcagaaagactggagtcattataggtttggtttgtcaaaggcacagatagtgtagttacatgcatgaggtactcaaggaaccagttcaagttctggggcacaatctagatgaaactgtgaggtttgttcaaaaagtaagtgtacaaaatttcatcatgaactggctttattacaactctttaccgtggtttattgaaaccacaatgtatactactttcctccagattctgattctaatgggcacatttgtttgttgaaatgataaatatattttccttgtcaaacatggtgggtcctggttgatatctcctgtttcctgccttgaaaaacatccttgttggtgcctttctcccactttggtacatcactcccaactgaaaacagtctagatataaactttaacaagctggagatctatttctacagcacaactctttcatgtttaaaagcaattatgccgtatcaggtgattgccacatgttggggaaagcagccatcttagagcaaaagtctgccaacccacagtccctgttgatccacatgtgggcattgtctaatgttaacaaaatcagcacttgtagacttactttctctgaacaatctagtacacttctctagtttctcccaacctggagaaaatgtatagcaaaagccagaggcaaaattattctccttagcagttctaagtatttcatgaaaaagccttcccccagtttaaatgcagaggctaaggtgatgactaacgaattaaggaaaactttggctcagatcagcaaaattattttggaaacttaatgtcccaagttaattattttttttatatcaaggggaagacatccagttctgtaggatgctaatagaagtgtgatatttagatgctattaggacattgtatacatttctttaatgtggttattttaagtttaggactgtaaatgttccctactggaatagaaatatgtctctctccaactttccaccaaataaaatggttagagtgaatgcccagtttcacatctgccttttggagtttggaaagcttaaacaagtcagttaagagaatgagaagaatctcactgtgggtgataaggagtgtgtagtttgctgtaagggccactgatatgacaagaatgattatcccacagtaagaatgggtaaaacttaataaagttttctaactttattaaactcacattatttaatgaaaaaataactgcaaaggaccaatgagatcatgcatgctgctgtattcttgtgatggaatctaccaggattaagttgtatttaaatgaaaaaacaggtacacatttagagatcattgaccaagaaatgtaaatatatttgattaataaaacgtttttatgatgactcga

SEQ ID NO: 168587 - DNA, 699 bp, Homo sapiens
  Payload ID: 13185
  Gene Symbol: PRDM6
  Gene Name: PR domain containing 6
  ENST ID: ENST00000434521
  CDS Start-End: 1-220
tgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggagtaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacagaccctaccaatgcggccactgctcccagtccttttcccagccttcagaactgaggaaccacgtggtcactcactctagtgaccggcctttcaagtgcggctactgtggtcgtgcctttgccggggccaccaccctcaac

SEQ ID NO: 168588 - DNA, 2008 bp, Homo sapiens
  Payload ID: 13186
  Gene Symbol: PRDM7
  Gene Name: PR domain containing 7
  Uniprot ID: Q9NQW5
  ENST ID: ENST00000449207
  CDS Start-End: 21-1499
ttctagacagtcccagcaccatgagccctgaaaggtcccaagaggagagcccagaaggagacacagagagaacagagcggaagcccatggtcaaagatgccttcaaagacatttccatatacttcaccaaggaagaatgggcagaaatgggagactgggagaaaactcgctataggaatgtgaaaatgaactataatgcactgattactgtaggtctcagagccactcgaccagctttcatgtgtcaccgaaggcaggccatcaaactccaggtggatgacacagaagattccgatgaagaatggacacctaggcagcaagtcaaacctccttggatggccttcagaggagaacagagtaaacaccagaagggaatgcccaaggcgtcattcaataatgaatctagtttgagagaattgtcaggaacgccaaatttactgaatacaagtgactcagagcaggctcagaaaccagtgtcccctcctggagaagcaagtacctctggacagcactctagactaaaactggaactcaggaggaaggagactgaaggaaagatgtatagcctgcgagaaagaaagggtcatgcatacaaagagatcagcgagccacaggatgatgactacctctattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgaggtatgtgaactgtgcccgggatgatgaagagcagaacctggtggccttccagtaccacaggcagatcttctatagaacctgccgagtcattaggccaggctgtgaactgctggtctggtctggggatgagtatggccaggaactgggcatcagatcttctatagaacctgccgagtcattaggccaggctgtgaactgctggtctggtatggggatgagtatggccaggaactgggcatcaagtggggcagcaagtggaagaaagagctcatggcagggagagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagacgccccagtctgcaggaaggatgagtaagtcattagtaataaaaccttatctcaatagccacaagaagacaaacgtgatcaccaca

SEQ ID NO: 168589 - DNA, 706 bp, Homo sapiens
  Payload ID: 13186
  Gene Symbol: PRDM7
  Gene Name: PR domain containing 7
  ENST ID: ENST00000568473
  CDS Start-End: 16-432
gacagtcccagcaccatgagccctgaaaggtcccaagaggagagcccagaaggagacacagagagaacagagcggaagcccatggtcaaagatgccttcaaagacatttccatatacttcaccaaggaagaatgggcagaaatgggagactgggagaaaactcgctataggaatgtgaaaatgaactataatgcactgattactgtaggtctcagagccactcgaccagctttcatgtgtcaccgaaggcaggccatcaaactccaggtggatgacacagaagattccgatgaagaatggacacctaggcagcaagtcaaacctccttggatggccttcagaggagaacagagtaaacaccagaagattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgag

SEQ ID NO: 168590 - DNA, 714 bp, Homo sapiens
  Payload ID: 13186
  Gene Symbol: PRDM7
  Gene Name: PR domain containing 7
  ENST ID: ENST00000564210
  CDS Start-End: 21-242
ttctagacagtcccagcaccatgagccctgaaaggtcccaagaggagagcccagaaggagacacagagagaacagagcggaagcccatggtctcagagccactcgaccagctttcatgtgtcaccgaaggcaggccatcaaactccaggtggatgacacagaagattccgatgaagaatggacacctaggcagcaagacagagtttcgctcttgtcaccccggctggagtgcaatggcgtgatctcagctcactaccacctccccatcccagaactcaggaggaaggagactgaaggaaagatgtatagcctgcgagaaagaaagggtcatgcatacaaagagatcagcgagccacaggatgatgactacctctattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgag

SEQ ID NO: 168591 - DNA, 4095 bp, Homo sapiens
  Payload ID: 13187
  Gene Symbol: PRDM8
  Gene Name: PR domain containing 8
  Uniprot ID: Q9NQV8
  ENST ID: ENST00000339711
  CDS Start-End: 1232-3301
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagc

SEQ ID NO: 168592 - DNA, 3124 bp, Homo sapiens
  Payload ID: 13187
  Gene Symbol: PRDM8
  Gene Name: PR domain containing 8
  Uniprot ID: Q9NQV8
  ENST ID: ENST00000415738
  CDS Start-End: 263-2332
gtcactgcatcgggtccatctgtacaactctctccgtttctccgtctctctccctccctccctccctccacccccccaatctttttctccccatctctccatctctctcttatctcttcaggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaa

SEQ ID NO: 168593 - DNA, 3706 bp, Homo sapiens
  Payload ID: 13187
  Gene Symbol: PRDM8
  Gene Name: PR domain containing 8
  Uniprot ID: Q9NQV8
  ENST ID: ENST00000504452
  CDS Start-End: 840-2909
ggcgtcccgcccccgccccggggaacgctgcctctgccgcaaagatgcccccttccgctggaaagcggtcataaaagccacctggggtgtcatttatcaacctctctccagcccactcttccaaaataacactacagtttcctacatgtgtatttttgccaggactccaaagagccttgctaaagtggaacaaggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagcaaa

SEQ ID NO: 168594 - DNA, 2514 bp, Homo sapiens
  Payload ID: 13187
  Gene Symbol: PRDM8
  Gene Name: PR domain containing 8
  ENST ID: ENST00000515013
  CDS Start-End: 1232-2514
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgc

SEQ ID NO: 168595 - DNA, 3691 bp, Homo sapiens
  Payload ID: 13188
  Gene Symbol: PRDM9
  Gene Name: PR domain containing 9
  Uniprot ID: Q9NQV7
  ENST ID: ENST00000296682
  CDS Start-End: 183-2867
ctctgagagaacgcccggccagggtgaacgccgcggcaggagagcacgggagattgtgaagagcatggggagcctttgtcgtgcagcgtgaaacccttgagcctttggcctaggagctgggagactcagggcccttctcacactcagaattggagcagggccttctagacagtcccagcaccatgagccctgaaaagtcccaagaggagagcccagaagaagacacagagagaacagagcggaagcccatggtcaaagatgccttcaaagacatttccatatacttcaccaaggaagaatgggcagagatgggagactgggagaaaactcgctataggaatgtgaaaaggaactataatgcactgattactataggtctcagagccactcgaccagctttcatgtgtcaccgaaggcaggccatcaaactccaggtggatgacacagaagattctgatgaagaatggacccctaggcagcaagtcaaacctccttggatggccttaagagtggaacagcgtaaacaccagaagggaatgcccaaggcgtcattcagtaatgaatctagtttgaaagaattgtcaagaacagcaaatttactgaatgcaagtggctcagagcaggctcagaaaccagtgtccccttctggagaagcaagtacctctggacagcactcaagactaaaactggaactcaggaagaaggagactgaaagaaagatgtatagcctgcgagaaagaaagggtcatgcatacaaagaggtcagcgagccgcaggatgatgattacctctattgtgagatgtgtcagaacttcttcattgacagctgtgctgcccatgggccccctacatttgtaaaggacagtgcagtggacaaggggcaccccaaccgttcagccctcagtctgcccccagggctgagaattgggccatcaggcatccctcaggctgggcttggagtatggaatgaggcatctgatctgccgctgggtctgcactttggcccttatgagggccgaattacagaagacgaagaggcagccaacaatggatactcctggctgatcaccaaggggagaaactgctatgagtatgtggatggaaaagataaatcctgggccaactggatgaggtatgtgaactgtgcccgggatgatgaagagcagaacctggtggccttccagtaccacaggcagatcttctatagaacctgccgagtcattaggccaggctgtgaactgctggtctggtatggggatgaatacggccaggaactgggcatcaagtggggcagcaagtggaagaaagagctcatggcagggagagaaccaaagccagagatccatccatgtccctcatgctgtctggccttttcaagtcagaaatttctcagtcaacatgtagaacgcaatcactcctctcagaacttcccaggaccatctgcaagaaaactcctccaaccagagaatccctgcccaggggatcagaatcaggagcagcaatatccagatccacacagccgtaatgacaaaaccaaaggtcaagagatcaaagaaaggtccaaactcttgaataaaaggacatggcagagggagatttcaagggccttttctagcccacccaaaggacaaatggggagctgtagagtgggaaaaagaataatggaagaagagtccagaacaggccagaaagtgaatccagggaacacaggcaaattatttgtgggggtaggaatctcaagaattgcaaaagtcaagtatggagagtgtggacaaggtttcagtgttaaatcagatgttattacacaccaaaggacacatacaggggagaagctctacgtctgcagggagtgtgggcggggctttagctggaagtcacacctcctcattcaccagaggatacacacaggggagaagccctatgtctgcagggagtgtgggcggggctttagctggcagtcagtcctcctcactcaccagaggacacacacaggggagaagccctatgtctgcagggagtgtgggcggggctttagccggcagtcagtcctcctcactcaccagaggagacacacaggggagaagccctatgtctgcagggagtgtgggcggggctttagccggcagtcagtcctcctcactcaccagaggagacacacaggggagaagccctatgtctgcagggagtgtgggcggggctttagctggcagtcagtcctcctcactcaccagaggacacacacaggggagaagccctatgtctgcagggagtgtgggcggggctttagctggcagtcagtcctcctcactcaccagaggacacacacaggggagaagccctatgtctgcagggagtgtgggcggggctttagcaataagtcacacctcctcagacaccagaggacacacacaggggagaagccctatgtctgcagggagtgtgggcggggctttcgcgataagtcacacctcctcagacaccagaggacacacacaggggagaagccctatgtctgcagggagtgtgggcggggctttagagataagtcaaacctcctcagtcaccagaggacacacacaggggagaagccctatgtctgcagggagtgtgggcggggctttagcaataagtcacacctcctcagacaccagaggacacacacaggggagaagccctatgtctgcagggagtgtgggcggggctttcgcaataagtcacacctcctcagacaccagaggacacacacaggggagaagccctacgtctgcagggagtgtgggcggggctttagcgataggtcaagcctctgctatcaccagaggacacacacaggggagaagccctacgtctgcagggaggatgagtaagtcattagtaataaaacctcatctcaatagccacaaaaagacaaatgtggtcaccacacacttgcacaccccagctgtgaggtggcttcagcggaagtctgctgaccccttatattccccgagagtataaagagatcggaaataactgattaaacaaatccgccactttcatgactagagatgaggaagaacaagggatagttctgtaagtgttcgggggacatcagcatgtgtggttctttcccgcactgatcccctccattttttgtttgtttttttgcctcctgttctaataaattttgtctccatacaaatctgaaccccaagtgtgtacctcattcttcccttatcactgaaggcaagaagagtccagaagggccacagagaactcatgtgttcagctcaagactccacaggaattcaacccccagaaagacataaacttggagtccgtctggtttaattattggagaatcgattcccaagtccaggaagagaaatgtaagattctagaaagtcgcagcaggaaagggagttccctggtctcctgggaagtgtggcttcttctcctaatggacacctctcctctgctgccatactctcccttggctccccagtctcctctcctgatctcctccaatctctgtagcccaagatgtgaaagccagacaagaacacgcgtgtgtgtatatatgtgttcgggtgtgggggtatgtgccctccgtgtaggtaactgtgtgagtgtggggggtttcaagggtgtgttaggaacaacgctcaaaatcctaaggaaactgaacactcgaacgaaggattcttagcaa

SEQ ID NO: 168596 - DNA, 558 bp, Homo sapiens
  Payload ID: 13188
  Gene Symbol: PRDM9
  Gene Name: PR domain containing 9
  ENST ID: ENST00000502755
  CDS Start-End: 258-558
aacttacaccacagttaaaggaacaccaaccctcccagatgagaatcagtgcaagaactctggcaattcaaaaagacacagtgtccccttggaagacccaggcctgcggagggacgtgaggagcagccccgacgcccgactcagtcgcaaacaccggagttggggaaaaccaagagcctttggcctaggagctgggagactcagggcccttctcacactcagaattggagcagggccttctagacagtcccagcaccatgagccctgaaaagtcccaagaggagagcccagaagaagacacagagagaacagagcggaagcccatggtcaaagatgccttcaaagacatttccatatacttcaccaaggaagaatgggcagagatgggagactgggagaaaactcgctataggaatgtgaaaaggaactataatgcactgattactataggtctcagagccactcgaccagctttcatgtgtcaccgaaggcaggccatcaaactccaggtggatgacacagaagattctgatgaagaatggacccctaggcagcaag

SEQ ID NO: 168597 - DNA, 1537 bp, Homo sapiens
  Payload ID: 13188
  Gene Symbol: PRDM9
  Gene Name: PR domain containing 9
  ENST ID: ENST00000635252
  CDS Start-End: 305-1537
gactggaagtttcctgaggtctcccagccatgcagaactagatctggacagtatcaagaggactcacaagaacgttgaaatatccagggcatataaaaaatgtgaagctttttataccacccttaggcctgcagaggcaggaagcaaacatcttgttactagatcgtgaagtaagagacagtgtctgctgctctgttgccagagctggatcacattggcaccatcacggctcactgcagcctcgacctctgggctcaagtgaatctcccgctgcagcctcccgaatagctgaaactacagacacatgccaccatacccaggtctcagagccactcgaccagctttcatgtgtcaccgaaggcaggccatcaaactccaggtggatgacacagaagattctgatgaagaatggacccctaggcagcaagtcaaacctccttggatggccttaagagtggaacagcgtaaacaccagaagggaatgcccaaggcgtcattcagtaatgaatctagtttgaaagaattgtcaagaacagcaaatttactgaatgcaagtggctcagagcaggctcagaaaccagtgtccccttctggagaagcaagtacctctggacagcactcaagactaaaactggaactcaggaagaaggagactgaaagaaagatgtatagcctgcgagaaagaaagggtcatgcatacaaagaggtcagcgagccgcaggatgatgattacctctattgtgagatgtgtcagaacttcttcattgacagctgtgctgcccatgggccccctacatttgtaaaggacagtgcagtggacaaggggcaccccaaccgttcagccctcagtctgcccccagggctgagaattgggccatcaggcatccctcaggctgggcttggagtatggaatgaggcatctgatctgccgctgggtctgcactttggcccttatgagggccgaattacagaagacgaagaggcagccaacaatggatactcctggctgatcaccaaggggagaaactgctatgagtatgtggatggaaaagataaatcctgggccaactggatgaggtatgtgaactgtgcccgggatgatgaagagcagaacctggtggccttccagtaccacaggcagatcttctatagaacctgccgagtcattaggccaggctgtgaactgctggtctggtatggggatgaatacggccaggaactgggcatcaagtggggcagcaagtggaagaaagagctcatggcagggagagaaccaaagccagagatccatccatgtccctcatgctgtctggccttttcaagtcagaaatttctcagtcaacatgtagaacgcaatcactcctctcagaacttcccaggaccatctgcaagaaaactcctccaaccagagaatccctgcccaggggatcagaatcaggagcagcaatatccagatccacacagccgtaatgacaaaaccaaaggtcaagagatcaaagaaaggtccaaactcttgaataaaaggacatggcagagg

SEQ ID NO: 168598 - DNA, 801 bp, Homo sapiens
  Payload ID: 13189
  Gene Symbol: PRAF2
  Gene Name: PRA1 domain family, member 2
  ENST ID: ENST00000376386
  CDS Start-End: 3-485
ggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttcgtgagtctccactaccccgagatagccaggaaagcagccagagcatgcttaaggcaccaggccagccctgccggtccccgggttgagagggggctgggaaacccgagggcctcgccacgcccccgctaaaagcgccttcccgggcttcgttcccccttctgggaacaccccttttattatcgcctttcctatctcactcttggtgttaagtgccttccactggccacgtccccgttaccgggcgtcttccctggccatgcccacgttgccaagccaattactcggccacgctttcagtatctgaggcgtcctggctgctcaccactccattggcctgcctgcgcgccaattcccttcggtgggccccggttggctgcaggctgaggtctattccactgacca

SEQ ID NO: 168599 - DNA, 1334 bp, Homo sapiens
  Payload ID: 13189
  Gene Symbol: PRAF2
  Gene Name: PRA1 domain family, member 2
  Uniprot ID: O60831
  ENST ID: ENST00000553851
  CDS Start-End: 85-621
cggtgtgccccgcggtggcgaggggcgtaacggttgttgtagtccggccccctcctggctggtccagccacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttctgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacccaggaccaagagccacctacatccagccccaaaactggcttcaggccagagcatccatggccaatttcaaattgtgaacccagagacactcccatccacccttctccatgctcatccccaaactggggcctggggcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgccaatttga

SEQ ID NO: 168600 - DNA, 2755 bp, Homo sapiens
  Payload ID: 13190
  Gene Symbol: PJA1
  Gene Name: praja ring finger 1, E3 ubiquitin protein ligase
  Uniprot ID: Q8NG27
  ENST ID: ENST00000361478
  CDS Start-End: 379-2310
acaatcacttccgccgccgcagtcgccgcccgccccgctgctgtctggcgggggaggagctcgggaccgggagcagcggctctggcggtcgtggcggtcggagatccgagagctctgcttctctgaaaagcgtgtggctttctggacttggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggtttt

SEQ ID NO: 168601 - DNA, 2672 bp, Homo sapiens
  Payload ID: 13190
  Gene Symbol: PJA1
  Gene Name: praja ring finger 1, E3 ubiquitin protein ligase
  Uniprot ID: Q8NG27
  ENST ID: ENST00000374571
  CDS Start-End: 490-2256
aggatgtgatgtagtaacgtaattactctcacattggacttaatcagaaagaatttgcagattttattttatttattaaaaaaccagaaggcaatatagctaaatgtttaacattagttaaagctgggtgtttgtgacatttttcgctgtccttttctgtatccttgacgatttcatcatttaagatgaaataatgctttcgggcccaccctgatttgtggagagcagctgccgcccccgccacatcaaggaggcgggctccagctgacttcacaatcacttccgccgccgcagtcgccgcccgccccgctgctgtctggcgggggaggagctcgggaccgggagcagcggctctggcggtcgtggcggtcggagatccgagagctctgcttctctgaaaagcgtgtggctttctggacttgtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaa

SEQ ID NO: 168602 - DNA, 2692 bp, Homo sapiens
  Payload ID: 13190
  Gene Symbol: PJA1
  Gene Name: praja ring finger 1, E3 ubiquitin protein ligase
  Uniprot ID: Q8NG27
  ENST ID: ENST00000374583
  CDS Start-End: 308-2239
gtcagattctcctctaagtctggctttcctgcaaacccagtcttgtaatcattttgccaacattaaaaatgtgttccaggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggta

SEQ ID NO: 168603 - DNA, 2115 bp, Homo sapiens
  Payload ID: 13190
  Gene Symbol: PJA1
  Gene Name: praja ring finger 1, E3 ubiquitin protein ligase
  Uniprot ID: Q8NG27
  ENST ID: ENST00000374584
  CDS Start-End: 295-1662
gcggtcgtggcggtcggagatccgagagctctgcttctctgaaaagcgtgtggctttctggacttggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggta

SEQ ID NO: 168604 - DNA, 574 bp, Homo sapiens
  Payload ID: 13190
  Gene Symbol: PJA1
  Gene Name: praja ring finger 1, E3 ubiquitin protein ligase
  ENST ID: ENST00000590146
  CDS Start-End: 141-574
gagcagcggctctggcggtcgtggcggtcggagatccgagagctctgcttctctgaaaagcgtgtggctttctggacttgggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaa

SEQ ID NO: 168605 - DNA, 544 bp, Homo sapiens
  Payload ID: 13190
  Gene Symbol: PJA1
  Gene Name: praja ring finger 1, E3 ubiquitin protein ligase
  ENST ID: ENST00000471141
  CDS Start-End: 1-203
tagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggtataa

SEQ ID NO: 168606 - DNA, 4889 bp, Homo sapiens
  Payload ID: 13191
  Gene Symbol: PJA2
  Gene Name: praja ring finger 2, E3 ubiquitin protein ligase
  Uniprot ID: O43164
  ENST ID: ENST00000361189
  CDS Start-End: 241-2367
cctctgcttccgccgccgccaccgccgccgccgccgccacagccgccagccgcttcgcgttcggcgggggaggagttggaggcggagaagaaggcggtggtggcgggtggaggttcgagcgctgttctcgctccggagccgctgcacatttcggaatcttctgcggcttgtccatagtgtgaataaaaactaaatcacatctataattctactgaactggtcacacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacaaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcaggaaggcaagaggtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgatttttgtttgtttccttttaagtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttctaata

SEQ ID NO: 168607 - DNA, 4645 bp, Homo sapiens
  Payload ID: 13191
  Gene Symbol: PJA2
  Gene Name: praja ring finger 2, E3 ubiquitin protein ligase
  Uniprot ID: O43164
  ENST ID: ENST00000361557
  CDS Start-End: 1-2127
atgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttcagcattgaatcaaaccactgagagcagtcaatcctttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacaaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcaggaaggcaagaggtggataacaccttttggaatggctgtggagattattaccaactctatgacaaagatgaagatagttctgaatgcagtgatggggaatggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaaggggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggagcctatttgatggctttgcagatggactaggagttgctgaagctatttcatatgtggatcctcagttccttacctacatggcactagaagaacgcttagcccaggctatggagactgctctggcccatttagagtctcttgcagtggatgttgaggtggccaatccaccagctagtaaggaaagcattgatggtcttccagagacccttgttcttgaagatcacactgctattggtcaggaacaatgctgtccaatctgttgcagtgagtatattaaggatgatatagcaacagagttgccctgtcaccatttctttcacaaaccttgtgtctcaatttggctacaaaagtcgggaacatgccctgtgtgccgccgtcatttcccacctgcggttattgaagcatctgcagctccttcctctgagcctgatcctgatgccccaccttcaaatgacagtattgcagaagcaccctaaaccttgacagttgaaatgagatcagtgtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgatttttgtttgtttccttttaagtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttctataaccccagcccatcattttctgtgtaaatcataaacaataaacagaatatactcggtggtcatttct

SEQ ID NO: 168608 - DNA, 2160 bp, Homo sapiens
  Payload ID: 13192
  Gene Symbol: PRAMEF1
  Gene Name: PRAME family member 1
  Uniprot ID: O95521
  ENST ID: ENST00000332296
  CDS Start-End: 104-1528
acccacagcactcattcctggagctactggttggtttcctgagaggtcccagaactctgcgaagtgagtccagcgctgagattttccttgcagatctatcaggatgagcatccaggccccacccagactactggagctggcagggcagagcctgctgagagaccaggccttgtccatctctgccatggaggagctgcccagggtgctctatctcccactcttcatggaggccttcagcaggagacacttccagactctgacggtgatggttcaggcctggcccttcacctgcctccctctgggatcactgatgaagacgcttcatttggagaccttaaaagcattgctggaagggcttcatatgctgcttacacagaaggatcgccccaggaggtggaaacttcaagtgctggatttgcgggatgttgacgagaatttctgggccagatggcctggagcctgggccctgtcctgcttcccagagaccacgagtaagaggcagacagcagaggactgtccaaggatgggagagcaccagcccttaaaggtgttcatagacatctgcctcaaggaaataccccaggatgaatgcctgagatacctcttccagtgggtttaccaaaggagaggtttagtacacctgtgctgtagtaagctggtcaattatctaacgccgattaaatatctcagaaagtcattgaaaataatatacctgaatagtattcaagagctggaaattcgcaacatgtcctggccacgtctgataagaaagcttcgttgttacctgaaggagatgaagaatcttcgcaaactcgttttctccaggtgccatcattacacgtcagataatgaactcgaaggacggttagttgccaaattcagctctgtgttcctcaggctggaacaccttcagttgcttaaaataaaattgatcaccttcttcagtgggcacctggaacagctgatcaggtgcctccagaaccccttggagaacttggaattaacttatggctacctattggaagaagacatgaagtgtctctcccagtacccaagcctcggttacctaaagcatctgaatctcagctacgtgctgctgttccgcatcagtcttgaacccctcggagctctgctggagaaaattgctgcctctctcaaaaccctcatcttggagggctgtcagatccactactcccaactcagtgccatcctgcctggcctgagccgctgctcccagctcaccaccttctactttggcagaaattgcatgtctattgacgccctgaaggacctgctgcgccacaccagtgggctgagcaagttaagcctggagacgtatcctgcccctgaggagagtttgaattccttggttcgtgtcaattgggagatcttcaccccacttcgggctgagctgatgtgtacactgagggaagtcaggcagcccaagaggatcttcattggccccaccccctgcccttcctgtggctcatcaccgtctgaggaactggagctccatctttgctgctagggaaggcgtgcccagtggggtagagaaatccaaagttctcttccaggcacttggacactaaaatctactatgtgggtgcaaactatttttctcttttcttatttatttcattttttaataattccaaaatttttattaaagacaatttgagacagggtttcgctgtgttgctccagctggtctcaaactgctgggcttatgggatcctcctgcctcagcttcctaaagtgctgggattactggcatgagtgactgtgtccaggccacatgcaacttaaaggaagcacaggcaagtgttcagtgtgagggaaaaaacataacagcagggggcaaggttggaggaaaatgttgaggtgacatcagtgagaacttcagggacccgtgtcctagagtcggaaagagaagctaaagttctacagtgatgagactgttatccctgcaaggatggttaccaaggaatatcagcaataaagagcacctgaatgaaaacttttaacctgttgtgcaatttatccatcagaaatctctagttatcgagttacggatggaaaaataacgaaatactaatttgtctgtgattgagtttcagttgtagaacatcaaagcaaccaaataaaaattagatcattttg

SEQ ID NO: 168609 - DNA, 1525 bp, Homo sapiens
  Payload ID: 13193
  Gene Symbol: PRAMEF10
  Gene Name: PRAME family member 10
  Uniprot ID: O60809
  ENST ID: ENST00000235347
  CDS Start-End: 81-1505
ttcctgcttagttcttcctgaggtctgagcaccctccaaactgagtccagatctgagttttccctcggagatttgtcagaatgagcctccaggccccatccagactgctggagctggcagggcagagcctgctgaggaaccagttcttgaccatcttcaccctggatgagctgcccagggaggtcttccctctgatgttcatggaggccttcagcatgagacgttttgaggccctgaagctgatggtgcaggcctggcccttcctccgcctccctctgggatccctgatgaagacacctcatctggagaccttgcaagctgtcctgaggggacttgatacactggtggcccagaaggttcgccccaggaggtggaaacttcaagtgctggatttgagggatgttgatgagaatttctggaccatatggtctggagccagggtcctctcctgctccccagaggccatgagtaagaggcagacagtggaggactgtccaaggatgggagagcgccagcccttgaaggtgttcatagacctctgcctaaaggaaagtacactggatgaatgcctgagctacctttttgggtggatccactacagaagaggcctagtgcacctgtgttgtagtaaggtgcagaattactcaatgcccacttcaagtttcagaaatctattggaaaggatatacccagacagtatccaggagttggaagtctggaaaaagtgctctctcaataaaacgggaaagtttgccccttacctgagccagatgagcaatcttcgtgaactctttttagccttcggttatgagcgtgagttgtacgtgagcgtccagtggccgtgcattcctgacttggactctccattcctctgcctgtactacccccagatgctttatataaaaaagatcagtaatatcaaagagcacctggagcacctgctcaggtacctcaagaaccccttgggggcctttatattcagtgatgcttacctaactgatcgggacatggagtgtctgtctcagtacccaagcctcagtcagctaaaggagctgcgtctgattcatatcctaatgtggaccaccaatcttgagccccttggagttctgctggagaaagttgctgctactctcaagaccctcgtcttaaaggactgtcggatccaggacccccaactcagggtcctcctgcctgccctgagccactgttcccagctcaccaccttcaactttcatggaaatgagacctccatgaatgctctgaaagacctgctgcgtcacacacgtgggctgagcaagttaggcctggagttgtatcctgcccctctggagagtcttgactacaagggtcatgtcaattgggagatcctcaccccaattcgggctgagctgatgcgtacactcagggaagtcaggcagcccaagaggatcttctttggtcccgtcccttgccctaactgtggctcatggccatctgagaaagtggacttccatctttgctcctagggaaggcctggttcgtggga

SEQ ID NO: 168610 - DNA, 1525 bp, Homo sapiens; identical to SEQ ID NO: 168609
  Payload ID: 13193
  Gene Symbol: PRAMEF10
  Gene Name: PRAME family member 10
  ENST ID: ENST00000632873
  CDS Start-End: 81-1505

SEQ ID NO: 168611 - DNA, 1845 bp, Homo sapiens
  Payload ID: 13194
  Gene Symbol: PRAMEF11
  Gene Name: PRAME family member 11
  ENST ID: ENST00000619922
  CDS Start-End: 72-1508
ttcctgcttggttcttcctgaggtctgagcaccttctagactacatccagatctgttttccctgcagattcatgaagatgagcatccggattccacccagactcctggagcttgcggggcggagcctgctgagggaccaagccttggccgtctccaccctggaggagctgcccacggaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcgtcccaggagatggaaacttcaagtgctggatttacaggatgtctgtgagaacttctggatggtttggtctgaagctatggcccatgggtgcttcctcaatgccaagaggaacaaaaaaccagtgcaggactgtccaaggatgagaggacggcagcccttgactgtgtttgtagaactttggctcaagaacaggactctggatgaatacctcacctgcctccttctatgggtcaagcagaggagagatttactacacctgtgctgtaagaagctgaaaattttgggaatgcccttccgcaatatcagaagcatcctgaaaatggtgaacctagactgtatccaggaggtggaagtgaattgcaagtggatactgcccatcctgacacagtttaccccatacctgggccacttgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgcctggagctgtatcctgccccgcaggaaagttatggtgctgatggtactctctgctggagcagatttgctcaaattagggctgagctgatgaagaaagtgaggcacttaaggcaccccaagaggatcttgttctgtactgacaactgccctgaccatggcgacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcgtttcacacatgggctctgaaagtgggaaaggaaagctgatcaagcaggggcaggacttgggggaaatgttgccatggattcaatgggactttgggaacctgtatcctgtagagtcgaaaatgggaatctgaatgtctagagtggaattcaggcttgagaatacatgagggagttactcttgcatggatggttgtaaagaaacaatcagaaataaaggaaaactgagcagaatct

SEQ ID NO: 168612 - DNA, 1845 bp, Homo sapiens; identical to SEQ ID NO: 168611
  Payload ID: 13194
  Gene Symbol: PRAMEF11
  Gene Name: PRAME family member 11
  ENST ID: ENST00000633392
  CDS Start-End: 72-1508

SEQ ID NO: 168613 - DNA, 1786 bp, Homo sapiens
  Payload ID: 13195
  Gene Symbol: PRAMEF12
  Gene Name: PRAME family member 12
  Uniprot ID: O95522
  ENST ID: ENST00000357726
  CDS Start-End: 28-1479
gatgtttttttctctagattcatcaggatgagcctccaggccccacctagactcctggagctggctgagcagagtctgctgagagaccgggccttggccatccccaccctggaggagctgcccagggagctctttcccccactgttcatggaggcctttaccaggagatgctgcgagaccctgacaactatggtgcaggcctggcccttcacctgccttcctctagggtccctgatgaagtcatgtaatctagagatctttcgagctgtgctggaggggcttgatgcactgcttgcccagaaggttcgccccaggcggtggaaacttcaagtgttggacttgcggaatgtggatgagaacttctggggcatatggtctggagcttctgcactctccccagaggccctgagtaagagacgaacagcagggaactgtccaaggccgggtgggcagcagcccttgatggtgatcctagacctttgcttcaagaatgggacgctggatgaatgcctcacccacttcttagagtggggcaagcagagaaaaggcttactgcacgtgtgttgcaaggagctgcagatttttggaatagccatccacaggatcatagaggtcctgaacacggtggagctagactgtatccaggaggtggaagtgtgctgcccgtgggagctgtccattcttataaggttcgccccttacctgggccagatgaggaatctccgcaaacttgttctcttcaacatccatgtctctgcctgcattcccctagacaggaaggagcagtttgtcatccagttcacctctcagttcctcaagctggactacttccagaagctttacatgcactctgtctctttcctcgaaggccacctggaccagctgctcaggtgtctccaggcccccttggagacagtcgtaatgaccgaatgcctgctgtcagagtcggacctgaagcatctctcttggtgcccgagcatccgtcagctaaaagagctagacctgaggggcatcacactgacccatttcagtcctgagcccctctcagttctgctggagcaagctgaggccaccctgcagaccctggacttagaggactgtgggatcgtggattcccaactcagcgccatcctgcctgccctgagccgctgctcccagctcagcaccttcagcttctgtgggaacctcatctccatggccgccctggagaacctgctgcgccacaccgtcgggctgagcaagctaagcctggagctgtatcctgcccctctggagagttatgatgcccagggtgctctctgctggggaagattttctcaacttggggctgagctgatgaagacactgagggacttaaggcagcccaagataattgtgttcagcactgtcccctgccctcgctgtggcatcagggcctcctatgacctggagcccagtcactgtctgttgaatgcctgctgtcagggtggatttatttaaagctttcttctggtcatttggcaactgaatcctaggccatgagtgtatgtcaaagggagcacagacccatcgtttcatatgcctgctcaatgtgaaccggaaaggaaaggggatgcaggaagggagggactgggggaaaagttgagttggagtcaataggagctttagagacctgtgtcccagagaatcagaaatgggaatctgaattgctagaatgagaatcaggtaggagagacacatgagacagttacccctgcacggatggttgtaaagaaacagtcagaaataaagggaagctgagtggaaa

SEQ ID NO: 168614 - DNA, 1690 bp, Homo sapiens
  Payload ID: 13196
  Gene Symbol: PRAMEF14
  Gene Name: PRAME family member 14
  ENST ID: ENST00000334600
  CDS Start-End: 104-1528
acccacagcactcattcctggagctactgcttggttccctgagaggtcccagaactctgcaaagtgagtccagcgctgagatttttcttgcagatctatcaggatgagcatccaggccccacccagactcctggagctggcagggcagagcctgctgagagaccaggccttgtccatctctgccatggaggagctgcccagggtgctctatctcccactcttcatggaggccttccgcaggagacacttccagactctgacggtgatggtgcaggcctggcccttcacctgcctccctctgggatcactgatgaagacgcttcatttggagaccttaaaagcattgctggaagggcttcatatgctgcttacacagaaggatcgccccaggaggtggaaacttcaagtgctggatttgcgggatgttgatgagaatttctgggccagatggcctggagcctgggccctgtcctgcttcccagagaccatgagtaagaggcagacagcagaggactgtccaaggatgggagagcaccagcccttaaaggtgttcatagacatctgcctcaaggaaataccccaggatgaatgcctgagatacctctttcagtgggtttaccaaaggagaggtttagtacacctgtgctgtagtaagctggtcaattatctaacgccgattaaacatctcagaaagtcattgaaaataatatacctgaatagtattcaacagctggaaattcgcaacatgtcctggccacgtctgataagaaagcttcgttgttacctgaaggagatgaagaatcttcgcaaactcgttttctccaggtgccatcattccatgtcagataatgaactcgaaggacggttagtcaccaaattcagctctgtgttcctcaggctggaacacctccagttgcttaaaataaaattgatcaccttcttcagtgggcacctggaacagctgatcaggtgcctccagaaccccttggagaacttggaattaacttatggctacctattggaagaagacatgaagtgtctctcccagtacccaagcctcggttacctaaagcatctgaatctcagctacgtgctgctgttccgcatcagtcttgaacccctcggagctctgctagagaaaattgctgcctctctcgaaaccctcatcttggagggctgtcagatccactactcccaactcagtgccatcctgcctggcctgagccactgctcccagctcaccaccttctactttggcagaaattgtatgtctatgggtgccctgaaggacctgttgtgccacaccagtgggctgagcaagttaagcctggagacgtatcctgcccctgaggagagtttgaattccttggttcgtgtcgattgggagatcttcgccctacttcgggctgagctgatgtgtacactgagggaagtcaggcagcccaagaggatcttcattggtcccaccccctgcccttcctgtggctcatcaccgtctgaggaactggagctccatctttgctgctagggaaggcgtgcctagcggggtagagaaatccaaagttctcttccaggcactgggacactaaaatctactatgtaggtgcaaactatttttctcttttcttatttatttcattttttaataattccaaaatttttattaaagacaatttgagacagggtttct

SEQ ID NO: 168615 - DNA, 1865 bp, Homo sapiens
  Payload ID: 13197
  Gene Symbol: PRAMEF15
  Gene Name: PRAME family member 15
  Uniprot ID: Q5VWM5
  ENST ID: ENST00000376152
  CDS Start-End: 95-1531
acccaaagtcttcaagcctggagttcctgcttggttcttcctgaggtctgagcaccttctagactacatccagatctgttttccctgcagattcatgaagatgagcatccggactccacccagactcctggagcttgcagggcggagcctgctgagggaccaagctttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggcttgatgcactgcttacccaaggggttcgtcccaggaggtggaaactccaagtgctggatttacaggatgtctgtgagaacttctggatggtttggtctgaagctatggcccatgggtgcttcctcaatgccaagaggaacaaaaaaccagtgcaggactgtccaaggatgagaggacggcagcccttgactgtgttcgtagaactttggctcaagaacaggactctggatgaatacctcacctacctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaagtcctcacaataactaactgtgtgcttttggaatcagacttgaagcatctatcccagtgcccgagtatcagtcaactaaagaccctggacctgagtggcatcagactgaccaattatagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgtgtggagctgtatcctgccccccgagagagttatggtgctgatggtactctctgctggagcagatttgctcaaattagggctgagctgatgaacagagtgagggacttaaggcaccccaagaggatcttgttctgtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggccggacttgggggaaatgttgccatggattcgatgggactttggggacctgtgtcctgtagattcgaaaatgggaatctgaatgtctagagtggaattcaggcttgagaatacatgagggagttactcttgcatggatggttgtaaagaaacaatcagaaataaaggaaaactgagcagaa

SEQ ID NO: 168616 - DNA, 1600 bp, Homo sapiens
  Payload ID: 13197
  Gene Symbol: PRAMEF15
  Gene Name: PRAME family member 15
  ENST ID: ENST00000613530
  CDS Start-End: 100-1530
acccaaagtcttcaagtctggagttcctgcttagttcttcctgaggtctgagcaccctccaaactgagtccagatctggtaagtcactaatctctgaagatgagcatccggactccacccagactcctggagcttgcagggcggagcctgctgagggaccaagctttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggcttgatgcactgcttacccaaggggttcgtcccaggaggtggaaactccaagtgctggatttacaggatgtctgtgagaacttctggatggtttggtctgaagctatggcccatgggtgcttcctcaatgccaagaggaacaaaaaaccagtgcaggactgtccaaggatgagaggacggcagcccttgactgtgttcgtagaactttggctcaagaacaggactctggatgaatacctcacctacctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaagtcctcacaataactaactgtgtgcttttggaatcagacttgaagcatctatcccagtgcccgagtatcagtcaactaaagaccctggacctgagtggcatcagactgaccaattatagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgtgtggagctgtatcctgccccccgagagagttatggtgctgatggtactctctgctggagcagatttgctcaaattagggctgagctgatgaacagagtgagggacttaaggcaccccaagaggatcttgttctgtactgactactgccctgactgtggcaacaggtcattttatgacctggaggcagatcaatactgctgttgaatgcctgcctatttggatgggtatgtcaaacgctttcttctggacacttggaaactaaaacctaggtctt

SEQ ID NO: 168617 - DNA, 1578 bp, Homo sapiens
  Payload ID: 13198
  Gene Symbol: PRAMEF17
  Gene Name: PRAME family member 17
  Uniprot ID: Q5VTA0
  ENST ID: ENST00000376098
  CDS Start-End: 27-1451
gagtttttcactggagatttgtcagaatgagcctccagtccccatccagactcctggagctggcaggccagagcctgctgaggaaccagttcttgaccatcttcatcctggacgagctgcccagggaggtcttccctctgatgttcatggaggcctccagcatgagacattttgaggccctgaagctgatggtgcaggcctggcccttcctccgcctccctctgggatccctgatgaagacacctcatctggagaccttgcaagctgtgctgaagggacttgatacactgctggcccagaagcttcgccccaggaggtggaaacttcaagtgctggatttgcgggatgttgatgggaatttctggactatatggtctggagccagggccctctcctgctccccagaggccatgagtaagaggcagacagtggaggactatccaaggacgggagagcaccagcccttgaaggtgttcatagacctctgccaaaaggaaagtacactggatgaatgcctgagctacctctgcaggtggatccactacagaagaggtctagtgcacctgtgttgtaataaggtgcagaattactcaatgcccacttcaagtttcagaaatttattgaaaagggtatacccagacagtatccaggagttggaaattaagagaaagtgctctctgaataaaacaggaaagtttgccccttacttgagccagatgagcaatcttcgcaaactctttttagccttcggttatgacgatgagttatatgtaagcggccaacagcagttcgttcctgacttggactgtccattcctctgcctgtactaccctcagatgctttatataagaaagatcagtaatatcaaagagcacctggagcacctgctcaggtgcctcaagaaccccttgggaacctttatattctgtcatgcttacctagctgatcaggacatggagtgtctgtctcagtacccaagcctcagtcagctaaaggagctgcatctgattcatatcctaatgtggactaccaatcttgagccccttggagctctgctagagaaagttgctgctactctcgagatcctcacgttaaaggactgtcagatccaggactcccagctcagggtcctcctgcctgccctgagccgctgctcccagctcaccaccttctactttcgcggaaatgagacctccacgaatgctctgaaagacctgctgtgtcacacaggtgggctgagcaagttaggtctggagttgtatcctgcccctctggagtgtcttgacaacaggggtcatgtcaattgggagatcctcgccccaattcgggctgagctgatgtgtacactcagggaagtcaggcagcccaagaggatcttttttggtcccatcccctgcccttcctgtggctcatggccatctgagaaagtggacttccatctttgctcttagtgaaggcctgattagtgggatggatatgctttcttcaggacccttaggcactaaaatctaggacacaggtgggtttttttgtttttttgttttttttttgatggagtctcgctctgtccctcaggct

SEQ ID NO: 168618 - DNA, 1440 bp, Homo sapiens
  Payload ID: 13199
  Gene Symbol: PRAMEF18
  Gene Name: PRAME family member 18
  ENST ID: ENST00000540591
  CDS Start-End: 1-1440
atgagcttccaggccccacgcagactcctggagctggcagggcagagcctgctgagggaccaggccttggccatctccgtcctggatgagctgcccagggagctcttccccccactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggtggaaacttcaagtgctggaaatgcgggatgttgatgagaatttttggaccatatggtctggagccaggctcctgtcctgctccccagaggccatgagtaagagacagacagtggaggactgtccaaggacaggagagaagcagcccttgaaggtgttcatggatgtttgcctcaaggaaaaattcatggatgaagatctgagcttcttctctgggtgggtgcagcacagaagaggttcagtacacctgtgctgtactaaggtggtgaattattcaatgagcattctaaatttcagaaacatattggaaacagtatacccagacagtatccaagtgttggaaatttggaacatgtgctggctgtgtatgatagtagagtttagccgttacctgagccagatgaggaatcttcgcaaactcttcatctctgatggctgtcgttacctgctaagctctgacagccaagaacagttagttgctgaattcagctctgtgctcctcaggctggagaacctccagatgctttatgtaagaagggtctgcttcttcagaggccacctggaccagctgatcaggtgcctcaggagcccgttggagacattggcattaacttatggcttcctagaagaagaggacttgaaatgcctgccccggtacccaagtctcagtcaactgaagcagctgaatctgagtcatggtgcactgcgcttcatccgtcttgagcccctccgagctctgctagagaaagttgctgccactcttcagaccctcttcttagtggactgtgggattgggtactccaaactcagggtcatcctgcctgccctgagccgctgctccaacctcaccactttctgttttcacggcaatgacacgtccatggatgctctgaaggacctgctgcgccacacaggcaggctgagcaatttgagcctggaaacatatcctgcccctcgggagagtcttgacaacaggggtcgtgtcattttggagctcctcaccccacttcaggctgagctgatgcgtatactgagggaagtaagggagcccaaaaggatcttctttggtccggtgtcctgcccttgctgtggcacttcgcccactgagcaactggagttcaatttttgcttgtggggaaggcctgcctag

SEQ ID NO: 168619 - DNA, 2104 bp, Homo sapiens
  Payload ID: 13199
  Gene Symbol: PRAMEF18
  Gene Name: PRAME family member 18
  ENST ID: ENST00000624297
  CDS Start-End: 22-1467
gatttgttttcttgcagatttatcaggatgagcttccaggccccacgcagactcctggagctggcagggcagagcctgctgagggaccaggccttggccatctccgtcctggatgagctgcccagggagctcttccccccactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggtggaaacttcaagtgctggaaatgcgggatgttgatgagaatttttggaccatatggtctggagccaggctcctgtcctgctccccagaggccatgagtaagagacagacagtggaggactgtccaaggacaggagagaagcagcccttgaaggtgttcatggatgtttgcctcaaggaaaaattcatggatgaagatctgagcttcttctctgggtgggtgcagcacagaagaggttcagtacacctgtgctgtactaaggtggtgaattattcaatgagcattctaaatttcagaaacatattggaaacagtatacccagacagtatccaagtgttggaaatttggaacatgtgctggctgtgtatgatagtagagtttagccgttacctgagccagatgaggaatcttcgcaaactcttcatctctgatggctgtcgttacctgctaagctctgacagccaagaacagttagttgctgaattcagctctgtgctcctcaggctggagaacctccagatgctttatgtaagaagggtctgcttcttcagaggccacctggaccagctgatcaggtgcctcaggagcccgttggagacattggcattaacttatggcttcctagaagaagaggacttgaaatgcctgccccggtacccaagtctcagtcaactgaagcagctgaatctgagtcatggtgcactgcgcttcatccgtcttgagcccctccgagctctgctagagaaagttgctgccactcttcagaccctcttcttagtggactgtgggattgggtactccaaactcagggtcatcctgcctgccctgagccgctgctccaacctcaccactttctgttttcacggcaatgacacgtccatggatgctctgaaggacctgctgcgccacacaggcaggctgagcaatttgagcctggaaacatatcctgcccctcgggagagtcttgacaacaggggtcgtgtcattttggagctcctcaccccacttcaggctgagctgatgcgtatactgagggaagtaagggagcccaaaaggatcttctttggtccggtgtcctgcccttgctgtggcacgtcgcccactgagcaactggagtccaatttttgcttgtggggaaggcctgcctagtggggtggaggtataaaaagctttttctccaggcacttggaaactaaaatctgggacatagatgtcttttatttttctttttccttattttacaattttacagcttttatttaaaaatttgaaacagggtttccctatgttgtccaggctggtctcaaactcttacgcttaagggagccccctgcttggcctcccaagattctgggattacaggcataagcagctgtgccgggtctataggtgtattataaagggaacagagaaacctctgtttcaggcatgtgctttctgtgagtggaaaacaaaaaacaaaaaatcccagcagggggcagcactggggaaaaagttgaatggagtcactgagactcagggatctgtgtcctagacagtcagaaatagaaagctgaagttctagagtgagggagttatctcagcaaggatggatacaaagaaacgtcggaagtagagggaacctaaatggaaactctctgctgtccttcatgattgattagcctgtttcagcaatttatacatcagaaatctttagttcctgatgaattaaaaaaagaggtactagttcatctgtgatttaggttcatctgcaggaaataaaggaatcaaaataaacttcatgttg

SEQ ID NO: 168620 - DNA, 2104 bp, Homo sapiens; identical to SEQ ID NO: 168619
  Payload ID: 13199
  Gene Symbol: PRAMEF18
  Gene Name: PRAME family member 18
  ENST ID: ENST00000632307
  CDS Start-End: 22-1467

SEQ ID NO: 168621 - DNA, 1233 bp, Homo sapiens
  Payload ID: 13200
  Gene Symbol: PRAMEF19
  Gene Name: PRAME family member 19
  Uniprot ID: Q5SWL8
  ENST ID: ENST00000376101
  CDS Start-End: 1-1233
atgaagacgcctgatctggagatcttacattatgtagtggatgggattgattgcctgcttgcccaaaaggttcgccccaggaggtggaaacttcaagtgctggaaatgcgggatgttgatgagaatttttggaccatatggtctggagccaggcccctgtcctgctccccagaggccatgagtaagagacagacagtggaggactgtccaaggacaggagagaagcagcccttgaaggtgttcatggatgtttgcctcaaggaaaaatccgtggatgaagatctgagcttcttctctgggtgggtgcagcacagaagacgttcagtacacctgtgctgtactaaggtggtaaattattcaatgaacattctaaatttcagaaacatattagaaacagtatacccagacagtatccaagtattggaaatttggaacatgtgctggccgtgtatggtagcagaggttagccgttacctgagccagatgaagaatcttcgaaaactcttcatctccgatggctgtggttacctgccaagctttgagagccaaggacagttagttgctgaattcagctctgtgttcctcaggctggagtacctccagatgctttatatgagaaggatccgcttcttcgaaggctacctggaccagctgatcaggtgcctcaagagcccgttggagacattggcattaacttatggctccctagatgaagaggacttgaaatgtctgccctggtacccaagtctcagtcaactgaagcagctgaatctgagtcatggtacactgcgcttcatccgtcttgagcccctccgagctctgctagagaaagttgctgccactcttcagaccctcttcttagtggactgtgggattggggactccaaactcagggtcatcctgcctgccctgagccgctgctccaacctcaccactttctgctttcacggcaatgacacgtccatggatggtctgaaggacctgctgcgccacacaggcaggctgagcaatttgagcctggaaacatatcctgcccctcgggagagtcttgacaacaggggtcgtgtcatttcggagctcctcaccccacttcaggctgagctgatgcgtatactgagggaagtaagggagcccaacaggatcttctttggtcccgtctcctgcccttgctgtggcatgtcacccactgagcaactggagttcaatttttgcttgcggggaaggcctgcctag

SEQ ID NO: 168622 - DNA, 1339 bp, Homo sapiens
  Payload ID: 13201
  Gene Symbol:
  Gene Name: PRAME family member 19 [Source:EntrezGene
  Acc:645414]
  ENST ID: ENST00000633764
  CDS Start-End: 1-702
gtaaaagaagagaaagtgcaccaaacctgtgcgtttcacagaggaagctctgtcctcacattagtgaacatgaatgatcctctctctgattccctgtctgtaaaaggttgttttgaactccaggaaaggtgcctcaggagcccgttggagacattggcattaacttatggcttcctagaagaagaggacttgaaatgcctgccccggtacccaagtctcagtcaactgaagcagctgaatctgagtcatggtgcactgcgcttcatccgtcttgagcccctccgagctctgctagagaaagttgctgccactcttcagaccctcttcttagtggactgtgggattgggtactccaaactcagggtcatcctgcctgccctgagccgctgctccaacctcaccactttctgttttcacggcaatgacacgtccatggatgctctgaaggacctgctgcgccacacaggcaggctgagcaatttgagcctggaaacatatcctgcccctcgggagagtcttgacaacaggggtcgtgtcattttggagctcctcaccccacttcaggctgagctgatgcgtatactgagggaagtaagggagcccaaaaggatcttctttggtccggtgtcctgcccttgctgtggcacttcgcccactgagcaactggagttcaatttttgcttgtggggaaggcctgcctagtggggtggaggtataaaaagctttttctccaggcacttggaaactaaaatctgggacatagatgtcttttatttttctttttccttattttacaattttacagcttttatttaaaaatttgagacagggtttccctatgttgtccaggctggtctcaaactcttacgcttaagggagccccctgcttggcctcccaagattctgggattacaggcataagcagctgtgccgggtctataggtgcattataaagggaacagagaaacctctgtttcaggcatgtgctttctgtgagtggaaaacaaaaaacaaaaaatcccagcagggggcagcactggggaaaaagttgaatggagtcactgagactcagggatctgtgtcctagacagtcagaaatagaaagctgaagttctagagtgagggagttatctcagcaaggatggatacaaagaaacgtcggaagtagagggaacctaaatggaaactctctgctgtccttcatgattgattagcctgtttcagcaatttatacatcagaaatctttagttcctgatgaattaaaaaaagaggtactagttcatctgtgatttagtttcatctgcaggaaataaaggaatcaaaataaacttcatgttg

SEQ ID NO: 168623 - DNA, 2125 bp, Homo sapiens
  Payload ID: 13201
  Gene Symbol:
  Gene Name: PRAME family member 19 [Source:EntrezGene
  Acc:645414]
  ENST ID: ENST00000631823
  CDS Start-End: 49-1488
ctgataagtttgtcttctctggatttgttttcttgcagatttatcaggatgagcttccaggccccacgcagactcctggagctggcagggcagagcctgctgagggaccaggccttggccatctccgtcctggatgagctgcccagggagctcttccccccactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggtggaaacttcaagtgctggaaatgcgggatgttgatgagaatttttggaccatatggtctggagccaggcccctgtcctgctccccagaggccatgagtaagagacagacagtggaggactgtccaaggacaggagagaagcagcccttgaaggtgttcatggatgtttgcctcaaggaaaaattcatggatgaagatctgagcttcttctctgggtgggtgcagcacagaagaggttcagtacacctgtgctgtactaaggtggtgaattattcaatgagcattctaaatttcagaaacatattggaaacagtatacccagacagtatccaagtgttggaaatttggaacatgtgctggctgtgtatgatagtagagtttagccgttacctgagccagatgaggaatcttcgcaaactcttcatctccgatggctgtcgttacctgctaagctctgacagccaagaacagttagttgctgaattcagctctgtgctcctcaggctggagaacctccagatgctttatgtaagaagggtctgcttcttcagaggccacctggaccagctgatcaggtgcctcaggagcccgttggagacattggcattaacttatggcttcctagaagaagaggacttgaaatgcctgccccggtacccaagtctcagtcaactgaagcagctgaatctgagtcatggtgcactgcgcttcatccgtcttgagcccctccgagctctgctagagaaagttgctgccactcttcagaccctcttcttagtggactgtgggattgggtactccaaactcagggtcatcctgcctgccctgagccgctgctccaacctcaccactttctgttttcacggcaatgacacgtccatggatgctctgaaggacctgctgcgccacacaggcaggctgagcaatttgagcctggaaacatatcctgcccctcgggagagtcttgacaacaggggtcgtgtcattttggagctcctcaccccacttcaggctgagctgatgcgtatactgagggaagtaagggagcccaaaaggatcttctttggtccggtgtcctgcccttgctgtggcacttcgcccactgagcaactggagttcaatttttgcttgtggggaaggcctgcctagtggggtggaggtataaaaagctttttctccaggcacttggaaactaaaatctgggacatagatgtcttttatttttctttttccttattttacaattttacagcttttatttaaaaatttgagacagggtttccctatgttgtccaggctggtctcaaactcttacgcttaagggagccccctgcttggcctcccaagattctgggattacaggcataagcagctgtgccgggtctataggtgcattataaagggaacagagaaacctctgtttcaggcatgtgctttctgtgagtggaaaacaaaaaacaaaaaatcccagcagggggcagcactggggaaaaagttgaatggagtcactgagactcagggatctgtgtcctagacagtcagaaatagaaagctgaagttctagagtgagggagttatctcagcaaggatggatacaaagaaacgtcggaagtagagggaacctaaatggaaactctctgctgtccttcatgattgattagcctgtttcagcaatttatacatcagaaatctttagttcctgatgaattaaaaaaagaggtactagttcatctgtgatttagtttcatctgcaggaaataaaggaatcaaaataaacttcatgttg

SEQ ID NO: 168624 - DNA, 1642 bp, Homo sapiens
  Payload ID: 13202
  Gene Symbol: PRAMEF2
  Gene Name: PRAME family member 2
  Uniprot ID: O60811
  ENST ID: ENST00000240189
  CDS Start-End: 88-1512
cctgaagctactggttggttccctgagaggtcccagaactctgcaaagtgagtccagcgctgagatttttcttgcagatccatcaggatgagcatccaggccccaccgagactactggagctggcggggcagagcctgctgagagaccaggccttgtccatctctgccatggaggagctgcccagggtgctctatctcccactcttcagggaggccttcagcaggagacacttccagactctgacggtgatggtgcaggcctggcctttcacctgcctccctctggtatcgctgatgaagacgcttcatctggagccattgaaagcattgctggaagggcttcatatgctgcttacacagaaggatcgccccaggaggtggaaacttcaagtgctggatttgcgggatgttgatgagaatttctgggccagatggcctggagcctgggccctgtcctgcttcccagaggccatgagtaagaggcagacagcagaggactgtccaaggacgggagagcaccagcccttaaaggtgttcatagacatctgcctcaaggaaataccccaggatgaatgcctgagatacctcttccagtgggtttaccaaaggagaggtttagtacacctgtgctgtagtaagctggtcaattatctaacgccaattaaatatctcagaaagtcattgaaaataatatacattaatagtattggggagctggaaattcacaacacgtgctggccacatctgataagaaagctttattgttacctgaaggagatgaagactctttgcaaactcgttttctccaggtgccatcattacacgtcagataatgaactcgagggatggttagtcaccagattcacctctgtgttcctcaggctggaacacctccagttgcttaaaataaaattgatcaccttcttcagtgggcacctggaacagctgatcaggtgcctccagaaccccttggagaacttggaattaacttgtggcaacctattagaagaggacttgaagtgtctctcccagttcccaagcctcggttacctaaagcatctgaatctcagctacgtgctgctgttccgcatcagtcttgaacccctaggagctctgctagagaaaattgctgcctctctcgagaccctcgtgttagagggctgtcagatccactactcccaactcagtgccatcctgcctggcctgagctgctgctcccagctcaccaccttctactttggcagcaattgcatgtctattgacgccctgaaggacctgctgcgccacaccagtgggctgagcaagttaagcctggagacgtatcctgcccctgaggagagtttgaattccttggttcgtgtcaattgggagatcttcaccccacttcgggctgagctgatgtgtacactgagggaattcaggcagcccaagaggatcttcattggccccaccccctgcccttcctgtggctcatcaccgtctgaggaactggagctccatctttgctgctagggaaggcgtgcccagtggggtagagaaatccaaagttctcttccaggcacttggacactaaaatctactatgtaggtgcaaactatttttctcttttcttatttatttcattttttaataattccaaaat

SEQ ID NO: 168625 - DNA, 1642 bp, Homo sapiens; identical to SEQ ID NO: 168624
  Payload ID: 13202
  Gene Symbol: PRAMEF2
  Gene Name: PRAME family member 2
  Uniprot ID: O60811
  ENST ID: ENST00000632257
  CDS Start-End: 88-1512

SEQ ID NO: 168626 - DNA, 1597 bp, Homo sapiens
  Payload ID: 13203
  Gene Symbol: PRAMEF20
  Gene Name: PRAME family member 20
  Uniprot ID: Q5VT98
  ENST ID: ENST00000316412
  CDS Start-End: 100-1527
acccaaagtcttcaagcctggagtttctgcttggtttttcctgaggtctgagcaccctgcaaactgagtccagatctggtaagtccctaatctctgaagatgagcatccggactccacccagactcctggagctggcggggcggagcctgctgagggacgaggccttggccatctccaccctggaggagctgcccacggaactttttcccccattgttcatggaggccttcagcaggagacactgtgaggccctgaagctgatggtgcaggcctggcctttcctccgccttcctctggggtctctgatgaaaaggccttgcccagagaccttccaagctgtgctcgatgggcttgatgcactgcttacccacagggttcgtctcaggaggtggaaacttcaagtgctggatttacaggatgtcagtgagaacttctggatggtttggtctgaagccatggcccgtaggtgcttaccaaatgccatgatgaacagaaaaccactgcaggactgtccaaggatgagaggacagcagcccttgactgtgttcatagacctttgcctcaagaacaggactctggatgaatacttcacctgcctctttctatgggtcaagcagagggaaggtttagtacacctgtgctgtaagaagctgaaaatgttgggaatgctcttccacaatatcagaaacatcctgaaaacagtcaacctagactgtatccaggaggtggaagtgaattgcaattggacactgcccgtcctggcagagtttaccccatacctcggccagatgaggaatcttcggaagctcgttctctctgacatagattctcgctacatttccccagagcagaagaaggagtttgttacccagttcaccactcagttcctcaagctgcgctgcctccaaaagctttatatgaactctgtttctttcctcgaaggccacctggaccagatgctcagctgtctaaagacctcgttaaacatcctcgcaataactaactgtgtgcttttggaatcagacttgaagcatctgtccaagtacccgagcattggtcaactaaagaccctggacctgagtggcaccagactggccaatttcagccttgtgccgctccaagttctcctagaaaaagttgcagccacccttgagtacctggacttagatgactgtggcatcgtagactcccaagtcaacgccatcctgcctgccctgagccgctgctttgagctcaccaccttcagcttccgtggaaatcccatctccacggccaccctggagaacctgctgtgccacacaatcagactcaacaacttatgcctggagctgtatcctgccccgcgggagagttatgatgttcgtggtatcgtctgccggagcagatttgcccaacttggggctgagctgatggggagagtgagggccttaagggagcccgagaggatcttgttctgtaccgactactgccctcagtgtggcaacaggtcactttacgacctggaggtagatcggtgttgctgttgaatgcctgcctatttgggtggatatatcaaactcttttttctgaacacttgaaaactaaaacctaggtctt

SEQ ID NO: 168627 - DNA, 1502 bp, Homo sapiens
  Payload ID: 13203
  Gene Symbol: PRAMEF20
  Gene Name: PRAME family member 20
  Uniprot ID: Q5VT98
  ENST ID: ENST00000602960
  CDS Start-End: 5-1432
gaagatgagcatccggactccacccagactcctggagctggcggggcggagcctgctgagggacgaggccttggccatctccaccctggaggagctgcccacggaactttttcccccattgttcatggaggccttcagcaggagacactgtgaggccctgaagctgatggtgcaggcctggcctttcctccgccttcctctggggtctctgatgaaaaggccttgcccagagaccttccaagctgtgctcgatgggcttgatgcactgcttacccacagggttcgtctcaggaggtggaaacttcaagtgctggatttacaggatgtcagtgagaacttctggatggtttggtctgaagccatggcccgtaggtgcttaccaaatgccatgatgaacagaaaaccactgcaggactgtccaaggatgagaggacagcagcccttgactgtgttcatagacctttgcctcaagaacaggactctggatgaatacttcacctgcctctttctatgggtcaagcagagggaaggtttagtacacctgtgctgtaagaagctgaaaatgttgggaatgctcttccacaatatcagaaacatcctgaaaacagtcaacctagactgtatccaggaggtggaagtgaattgcaattggacactgcccgtcctggcagagtttaccccatacctcggccagatgaggaatcttcggaagctcgttctctctgacatagattctcgctacatttccccagagcagaagaaggagtttgttacccagttcaccactcagttcctcaagctgcgctgcctccaaaagctttatatgaactctgtttctttcctcgaaggccacctggaccagatgctcagctgtctaaagacctcgttaaacatcctcgcaataactaactgtgtgcttttggaatcagacttgaagcatctgtccaagtacccgagcattggtcaactaaagaccctggacctgagtggcaccagactggccaatttcagccttgtgccgctccaagttctcctagaaaaagttgcagccacccttgagtacctggacttagatgactgtggcatcgtagactcccaagtcaacgccatcctgcctgccctgagccgctgctttgagctcaccaccttcagcttccgtggaaatcccatctccacggccaccctggagaacctgctgtgccacacaatcagactcaacaacttatgcctggagctgtatcctgccccgcgggagagttatgatgttcgtggtatcgtctgccggagcagatttgcccaacttggggctgagctgatggggagagtgagggccttaagggagcccgagaggatcttgttctgtaccgactactgccctcagtgtggcaacaggtcactttacgacctggaggtagatcggtgttgctgttgaatgcctgcctatttgggtggatatatcaaactcttttttctgaacacttgaaaactaaaacctaggtctt

SEQ ID NO: 168628 - DNA, 1840 bp, Homo sapiens
  Payload ID: 13204
  Gene Symbol: PRAMEF25
  Gene Name: PRAME family member 25
  ENST ID: ENST00000632549
  CDS Start-End: 72-1508
tacctgcctggttcttcctgaggtctgagcaccttctagactacatccagatctgttttccctgcagattcatgaagatgagcatccggactccacccagactcctggagctggcggggcggagcgtgctgagggaccaagccttggccatgtccaccctggaggagctgcccacagaacttttccccccactgttcatggaggccttcagcaggagacgctgtgaggccctgaagctgatggtacaggcctggcccttccgccgcctccctctgaggcctctgataaagatgccttgtctggagaccttccaagctgtgctcaatgggcttgatgcactgcttacccacggggttcgtcccaggaggtggaaacttcaagtgctggatttacaggatgtctgtgagaacttctggatggtttggtctgaagctatggcccgtgggtgcttcctcaatgccaagaggaacaaaaaaccagtgcaggactgtccaaggatgagaggacggcagcccttgactgtgttcgtagaactttggctcaagaacaggactctggatgaacacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcctggagctgtatcctgccccacgggagagttatggtgctgatggtactctctgctggagcagatttgctcaaattagggctgagctgatgaacagagtgagggacttaaggcaccccaagaggatctttttctgtattgataactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggcaggacttgggggaaatgttgccatggattcgatgggactttggggacctgtatcctgtagagtcgaaaatgggaatctgaatgtctagagtggagttcaggcttgagaatacatgagggagttactcttgcatggatggttgtaaagaaacaatcagaaataaaggaaaactgagcag

SEQ ID NO: 168629 - DNA, 1863 bp, Homo sapiens
  Payload ID: 13204
  Gene Symbol: PRAMEF25
  Gene Name: PRAME family member 25
  Uniprot ID: A6NGN4
  ENST ID: ENST00000633532
  CDS Start-End: 95-1531
acccaaagtcttcaagcctggagttcctgcctggttcttcctgaggtctgagcaccttctaaactacatccagatctgttttccctgcagattcatgaagatgagcatccggactccacccagactcctggagctggcggggcggagcgtgctgagggaccaagccttggccatgtccaccctggaggagctgcccacagaacttttccccccactgttcatggaggccttcagcaggagacgctgtgaggccctgaagctgatggtacaggcctggcccttccgccgcctccctctgaggcctctgataaagatgccttgtctggagaccttccaagctgtgctcaatgggcttgatgcactgcttacccacggggttcgtcccaggaggtggaaacttcaagtgctggatttacaggatgtctgtgagaacttctggatggtttggtctgaagctatggcccgtgggtgcttcctcaatgccaagaggaacaaaaaaccagtgcaggactgtccaaggatgagaggacggcagcccttgactgtgttcgtagaactttggctcaagaacaggactctggatgaacacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcctggagctgtatcctgccccacgggagagttatggtgctgatggtactctctgctggagcagatttactcagattagggctgagctgatgaagagagttagggacttaaggcaccccaagaggatcttgttcggtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcgtttcacacatgggctctgaaagtgggaaaggaatgctgatcaagcaggggcaggacttgggggaaatgttgccatggattcgatgggactttgggaacgtgtatcctgtagagtcgaaaatgggaatctgaatgtctagagtggaattcaggcttgagaatacatgagggagttactcttgcatggatggttgtaaagaaacaatcagaaataaaggaaaactgagcag

SEQ ID NO: 168630 - DNA, 1840 bp, Homo sapiens
  Payload ID: 13205
  Gene Symbol:
  Gene Name: PRAME family member 25 [Source:EntrezGene
  Acc:441873]
  Uniprot ID: A6NGN4
  ENST ID: ENST00000619661
  CDS Start-End: 72-1508
ttcctgcctggttcttcctgaggtctgagcaccttctaaactacatccagatctgttttccctgcagattcatgaagatgagcatccggactccacccagactcctggagctggcggggcggagcgtgctgagggaccaagccttggccatgtccaccctggaggagctgcccacagaacttttccccccactgttcatggaggccttcagcaggagacgctgtgaggccctgaagctgatggtacaggcctggcccttccgccgcctccctctgaggcctctgataaagatgccttgtctggagaccttccaagctgtgctcaatgggcttgatgcactgcttacccacggggttcgtcccaggaggtggaaacttcaagtgctggatttacaggatgtctgtgagaacttctggatggtttggtctgaagctatggcccgtgggtgcttcctcaatgccaagaggaacaaaaaaccagtgcaggactgtccaaggatgagaggacggcagcccttgactgtgttcgtagaactttggctcaagaacaggactctggatgaacacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcctggagctgtatcctgccccacgggagagttatggtgctgatggtactctctgctggagcagatttactcagattagggctgagctgatgaagagagttagggacttaaggcaccccaagaggatcttgttcggtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcgtttcacacatgggctctgaaagtgggaaaggaatgctgatcaagcaggggcaggacttgggggaaatgttgccatggattcgatgggactttgggaacgtgtatcctgtagagtcgaaaatgggaatctgaatgtctagagtggaattcaggcttgagaatacatgagggagttactcttgcatggatggttgtaaagaaacaatcagaaataaaggaaaactgagcag

SEQ ID NO: 168631 - DNA, 1600 bp, Homo sapiens
  Payload ID: 13205
  Gene Symbol:
  Gene Name: PRAME family member 25 [Source:EntrezGene
  Acc:441873]
  ENST ID: ENST00000618988
  CDS Start-End: 100-1530
acccaaagtcttcaagcctggagttcctgcttggttcttcctgaggtctgaacaccctgcaaactgagcccagatctggtaagtcactaatttctgaagatgagcatccggactccacccagactcctggagctggcggggcggagcgtgctgagggaccaagccttggccatgtccaccctggaggagctgcccacagaacttttccccccactgttcatggaggccttcagcaggagacgctgtgaggccctgaagctgatggtacaggcctggcccttccgccgcctccctctgaggcctctgataaagatgccttgtctggagaccttccaagctgtgctcaatgggcttgatgcactgcttacccacggggttcgtcccaggaggtggaaacttcaagtgctggatttacaggatgtctgtgagaacttctggatggtttggtctgaagctatggcccgtgggtgcttcctcaatgccaagaggaacaaaaaaccagtgcaggactgtccaaggatgagaggacggcagcccttgactgtgttcgtagaactttggctcaagaacaggactctggatgaacacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcctggagctgtatcctgccccacgggagagttatggtgctgatggtactctctgctggagcagatttactcagattagggctgagctgatgaagagagttagggacttaaggcaccccaagaggatcttgttcggtactgactactgccctgactgtggcaacaggtcattttatgacctggaggcagatcaatactgctgttgaatgcctgcctatttggatgggtatgtcaaacgctttcttctggacacttggaaactaaaacctaggtctt

SEQ ID NO: 168632 - DNA, 1840 bp, Homo sapiens
  Payload ID: 13205
  Gene Symbol:
  Gene Name: PRAME family member 25 [Source:EntrezGene
  Acc:441873]
  ENST ID: ENST00000615936
  CDS Start-End: 198-1508
tacctgcctggttcttcctgaggtctgagcaccttctagactacatccagatctgttttccctgcagattcatgaagatgagcatccggactccacccagactcctggagctggcggggcggagcgtgctgagggaccaagccttggccatgtccaccctggaggagctgcccacagaacttttccccccactgttcatggaggccttcagcaggagacgctgtgaggccctgaagctgatggtacaggcctggcccttccgccgcctccctctgaggcctctgataaagatgccttgtctggagaccttccaagctgtgctcaatgggcttgatgcactgcttacccacggggttcgtcccaggaggtggaaacttcaagtgctggatttacaggatgtctgtgagaacttctggatggtttggtctgaagctatggcccgtgggtgcttcctcaatgccaagaggaacaaaaaaccagtgcaggactgtccaaggatgagaggacggcagcccttgactgtgttcgtagaactttggctcaagaacaggactctggatgaacacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcctggagctgtatcctgccccacgggagagttatggtgctgatggtactctctgctggagcagatttactcagattagggctgagctgatgaagagagttagggacttaaggcaccccaagaggatcttgttcggtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcgtttcacacatgggctctgaaagtgggaaaggaatgctgatcaagcaggggcaggacttgggggaaatgttgccatggattcgatgggactttgggaacgtgtatcctgtagagtcgaaaatgggaatctgaatgtctagagtggaattcaggcttgagaatacatgagagagttactcttgcatggatggttgtaaagaaacaatcagaaataaaggaaaactgagcag

SEQ ID NO: 168633 - DNA, 1600 bp, Homo sapiens; identical to SEQ ID NO: 168631
  Payload ID: 13205
  Gene Symbol:
  Gene Name: PRAME family member 25 [Source:EntrezGene
  Acc:441873]
  ENST ID: ENST00000615797
  CDS Start-End: 100-1530

SEQ ID NO: 168634 - DNA, 1863 bp, Homo sapiens
  Payload ID: 13205
  Gene Symbol:
  Gene Name: PRAME family member 25 [Source:EntrezGene
  Acc:441873]
  Uniprot ID: A6NGN4
  ENST ID: ENST00000614839
  CDS Start-End: 95-1531
acccaaagtcttcaagcctggagtacctgcctggttcttcctgaggtctgagcaccttctagactacatccagatctgttttccctgcagattcatgaagatgagcatccggactccacccagactcctggagctggcggggcggagcgtgctgagggaccaagccttggccatgtccaccctggaggagctgcccacagaacttttccccccactgttcatggaggccttcagcaggagacgctgtgaggccctgaagctgatggtacaggcctggcccttccgccgcctccctctgaggcctctgataaagatgccttgtctggagaccttccaagctgtgctcaatgggcttgatgcactgcttacccacggggttcgtcccaggaggtggaaacttcaagtgctggatttacaggatgtctgtgagaacttctggatggtttggtctgaagctatggcccgtgggtgcttcctcaatgccaagaggaacaaaaaaccagtgcaggactgtccaaggatgagaggacggcagcccttgactgtgttcgtagaactttggctcaagaacaggactctggatgaacacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcctggagctgtatcctgccccacgggagagttatggtgctgatggtactctctgctggagcagatttactcagattagggctgagctgatgaagagagttagggacttaaggcaccccaagaggatcttgttcggtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcgtttcacacatgggctctgaaagtgggaaaggaatgctgatcaagcaggggcaggacttgggggaaatgttgccatggattcgatgggactttgggaacgtgtatcctgtagagtcgaaaatgggaatctgaatgtctagagtggaattcaggcttgagaatacatgagggagttactcttgcatggatggttgtaaagaaacaatcagaaataaaggaaaactgagcag

SEQ ID NO: 168635 - DNA, 1863 bp, Homo sapiens
  Payload ID: 13205
  Gene Symbol:
  Gene Name: PRAME family member 25 [Source:EntrezGene
  Acc:441873]
  Uniprot ID: A6NGN4
  ENST ID: ENST00000613059
  CDS Start-End: 95-1531
acccaaagtcttcaagcctggagttcctgcctggttcttcctgaggtctgagcaccttctaaactacatccagatctgttttccctgcagattcatgaagatgagcatccggactccacccagactcctggagctggcggggcggagcgtgctgagggaccaagccttggccatgtccaccctggaggagctgcccacagaacttttccccccactgttcatggaggccttcagcaggagacgctgtgaggccctgaagctgatggtacaggcctggcccttccgccgcctccctctgaggcctctgataaagatgccttgtctggagaccttccaagctgtgctcaatgggcttgatgcactgcttacccacggggttcgtcccaggaggtggaaacttcaagtgctggatttacaggatgtctgtgagaacttctggatggtttggtctgaagctatggcccgtgggtgcttcctcaatgccaagaggaacaaaaaaccagtgcaggactgtccaaggatgagaggacggcagcccttgactgtgttcgtagaactttggctcaagaacaggactctggatgaacacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcctggagctgtatcctgccccacgggagagttatggtgctgatggtactctctgctggagcagatttactcagattagggctgagctgatgaagagagttagggacttaaggcaccccaagaggatcttgttcggtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcgtttcacacatgggctctgaaagtgggaaaggaatgctgatcaagcaggggcaggacttgggggaaatgttgccatggattcgatgggactttgggaacgtgtatcctgtagagtcgaaaatgggaatctgaatgtctagagtggaattcaggcttgagaatacatgagagagttactcttgcatggatggttgtaaagaaacaatcagaaataaaggaaaactgagcag

SEQ ID NO: 168636 - DNA, 1600 bp, Homo sapiens; identical to SEQ ID NO: 168631
  Payload ID: 13205
  Gene Symbol:
  Gene Name: PRAME family member 25 [Source:EntrezGene
  Acc:441873]
  ENST ID: ENST00000634064
  CDS Start-End: 100-1530

SEQ ID NO: 168637 - DNA, 1863 bp, Homo sapiens; identical to SEQ ID NO: 168634
  Payload ID: 13205
  Gene Symbol:
  Gene Name: PRAME family member 25 [Source:EntrezGene
  Acc:441873]
  Uniprot ID: A6NGN4
  ENST ID: ENST00000632559
  CDS Start-End: 95-1531

SEQ ID NO: 168638 - DNA, 1840 bp, Homo sapiens; identical to SEQ ID NO: 168630
  Payload ID: 13205
  Gene Symbol:
  Gene Name: PRAME family member 25 [Source:EntrezGene
  Acc:441873]
  Uniprot ID: A6NGN4
  ENST ID: ENST00000634012
  CDS Start-End: 72-1508

SEQ ID NO: 168639 - DNA, 1840 bp, Homo sapiens; identical to SEQ ID NO: 168628
  Payload ID: 13206
  Gene Symbol: PRAMEF26
  Gene Name: PRAME family member 26
  ENST ID: ENST00000621259
  CDS Start-End: 72-1508

SEQ ID NO: 168640 - DNA, 1863 bp, Homo sapiens; identical to SEQ ID NO: 168629
  Payload ID: 13206
  Gene Symbol: PRAMEF26
  Gene Name: PRAME family member 26
  Uniprot ID: A6NGN4
  ENST ID: ENST00000624207
  CDS Start-End: 95-1531

SEQ ID NO: 168641 - DNA, 1863 bp, Homo sapiens
  Payload ID: 13207
  Gene Symbol: PRAMEF27
  Gene Name: PRAME family member 27
  ENST ID: ENST00000436041
  CDS Start-End: 95-1531
acccaaagtcttcaagcctggagttcctgcctggttcttcctgaggtctgagcaccttctaaactacatccagatctgttttccctgcagattcatgaagatgagcatccggactccacccagactcctggagcttgcggggcggagcctgctgagggaccaagccttggccatgtccaccctggaggagctgcccacagaacttttccccccactgttcatggaggccttcagcaggagatgctgtgaggccctgaagctgatggtgcaggcctggcccttccgccgcctccctctgaggcctctgataaagatgccttgtctggaggccttccaagctgtgctcgatgggcttgatgcactgcttacccaaggggtttgtcccaggaggtggaaacttcaagtgctggatttacaggatgtctgtgagaacttctggatggtttggtctgaagctatggcccgtgggtccttcctcaatgccaagaggaacaaaacaccagtgcaggactgtccaaggatgagaggacagcagcccttgactgtgttcgtagaactttggctcaagaacaggactctggatgaatacctcacctacctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctctcacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacttggatttagatgactgtggcatcatagactcccaagtcaacgccatcctgcctgccctgagccgctgctttgagctcaatgccttcagcttctgtggaaatcccatctccatggccaccctggagaacctgctgagccacacaatcatactcaaaaacttatgcgtggaggtgtatcctgccccgcgggagagttatggtgctgatggtactctctgctggaacagatttgctcaaattagggctgagctgatgaacagagtgagggacttaaggcaccccaagaggatctttttctgtattgataactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggcaggacttgggggaaatgttgccatggattcgatgggactttggggacctgtatcctgtagagtcgaaaatgggaatctgaatgtctagagtggagttcaggcttgagaatacatgagggagttactcttgcatggatggttgtaaagaaacaatcagaaataaaggaaaactgagcag

SEQ ID NO: 168642 - DNA, 1863 bp, Homo sapiens; identical to SEQ ID NO: 168641
  Payload ID: 13207
  Gene Symbol: PRAMEF27
  Gene Name: PRAME family member 27
  ENST ID: ENST00000631964
  CDS Start-End: 95-1531

SEQ ID NO: 168643 - DNA, 1604 bp, Homo sapiens
  Payload ID: 13208
  Gene Symbol: PRAMEF33P
  Gene Name: PRAME family member 33, pseudogene
  ENST ID: ENST00000621403
  CDS Start-End: 81-1505
ttcctgcttagttcttcctgaggtctgagcaccctccaaactgagtccagatctgagtttttcctcggagatttgtcagaatgagcctccaggccccatccagactgctggagctggcagggcagagcctgctgaggaaccagttcttgaccatcttcaccctggatgagctgcccagggaggtcttccctctgatgttcatggaggccttcagcatgagacgttttgaggccctgaagctgatggtgcaggcctggcccttcctccgcctccctctgggatccctgatgaagacacctcatctggagaccttgcaagctgtcctgaggggacttgatacactggtggcccagaaggttcgccccaggaggtggaaacttcaagtgctggatttgcaggatgttgatgagaatttctggaccatatggtctggagccagggtcctctcctgctccccagaggccatgagtaagaggcagacagtggaggactgtccaaggatgggagagcaccagcccttgaaggtgttcatagacctctgcctaaaggaaagtacactggatgaatgcctgagctacctttttgggtggatccactacagaagaggcctagtgcacctgtgttgtagtaaggtgcagaattactcaatgcccacttcaagtttcagaaatctattggaaaggatatacccagacagtatccaggagttggaagtctggaaaaagtgctctctcaataaaacgggaaagtttgccccttacctgagccagatgagcaatcttcgtgaactctttttagccttcggttatgagcgtgagttgtacgtgagcgtccagtggccgtgcattcctgacttggactctccattcctctgcctgtactacccccagatgctttatataaaaaagatcagtaatatcaaagagcacctggagcacctgctcaggtacctcaagaaccccttgggggcctttatattcagtgatgcttacctagctgatcgggacatggagtgtctgtctcagtacccaagcctcagtcagctaaaggagctgcgtctgattcatatcctaatgtggaccaccaatcttcagccccttggagctctgctagagaaagttgctgctactctcaagaccctcgtcttaaaggactgtcggatccaggacccccaactcagggtcctcctgcctgccctgagccactgttcccagctcaccaccttcaactttcatggaaatgagacctccatgaatgctctgaaagacctgctgcgtcacacacgtgggctgagcaagttaggcctggagttgtatcctgcccctctggagagtcttgactacaagggtcatgtcaattgggagatcctcaccccaattcgggctgagctgatgcgtacactcagggaagtcaggcagcccaagaggatcttctttggtcccgtcccttgccctacctgtggctcatggccatctgagaaagtggacttccatctttgctcctagggaaggcctggttcgtgggatggataagcttttttctggacacttgggaactaaaatattgtacatgggtgcattttttaaaattttattttatttttt

SEQ ID NO: 168644 - DNA, 1828 bp, Homo sapiens
  Payload ID: 13209
  Gene Symbol: PRAMEF4
  Gene Name: PRAME family member 4
  Uniprot ID: O60810
  ENST ID: ENST00000235349
  CDS Start-End: 72-1508
ttcctgcttggttcttcctgagatctgagaaccttctagactacatccagatctgttttccctgcagattcatgaagatgagcatctggactccacccagactcctggagcttgcagggcggagcctgctaagggaccaagctttggccatgtccaccctggaggagctgcccacagaacttttccccccactgttcatggaggccttcagcaggagacgctgtgaggccctgaagctgatggtgcagtcctggcccttccgccgcctccctctgaggcctctgataaagatgccttgtctggaggccttccaagctgtgctcgatgggctggatgcactgcttaacctaggggttcgtcccaggaggtggaaacttcaagtgctggatttacaggatgtctgtgagaacttctggatggtttggtctgaagctatggcccatgggtgcttcctcaatgccaagaggaacaaaaaaccagtggaggactgtccaaggatgaaaggacggcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaaactcattctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaagttcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcttgcctgccctgagccgctgctttgagctcaacaccttcagcttctgtggaaatcccatctgcatggccaccctggagaacctgctgagccacacaatcatactcaaaaacttatgcgtggagctgtatcctgccccccgggagagttatggtgctgatggtactctctgctggagcagatttgctcaaattagggctgagctgatgaacagagtgagggacttaaggcaccccaagaggatcttgttctgtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggccggacttgggggaaatgttgccatggattcgatgggactttggggacctgtgtcctgtagagtcgaaaatgggaatctgaatgtctagagtggaattcaggcttgagaatacatgagggagttactcttgcatggatggttgtaaagaaacaatcagaaataaagg

SEQ ID NO: 168645 - DNA, 1828 bp, Homo sapiens; identical to SEQ ID NO: 168644
  Payload ID: 13209
  Gene Symbol: PRAMEF4
  Gene Name: PRAME family member 4
  ENST ID: ENST00000632563
  CDS Start-End: 72-1508

SEQ ID NO: 168646 - DNA, 1699 bp, Homo sapiens
  Payload ID: 13210
  Gene Symbol: PRAMEF5
  Gene Name: PRAME family member 5
  ENST ID: ENST00000618079
  CDS Start-End: 81-1517
agcctggagttcctgcctggttcttcctgaggtctgagcaccttctaaactacatccagatctgttttccctgcagattcatgaagatgagcatccggactccacccagactcctggagcttgcggggcggagcctgctgagggaccaagccttggccatgtccaccctggaggagctgcccacagaacttttccccccactgttcatggaggccttcagcaggagatgctgtgaggccctgaagctgatggtgcaggcctggcccttccgccgcctccctctgaggcctctgataaagatgccttgtctggaggccttccaagctgtgctcgatgggcttgatgcactgcttacccaaggggtttgtcccaggaggtggaaacttcaagtgctggatttacaggatgtctgtgagaacttctggatggtttggtctgaagctatggcccatgggtgcttcctcaatgccaagaggaacaaaaaaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttcctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaaggaaaggtgatcaagcaggggcaggacttgggggaagtgttgccatggat

SEQ ID NO: 168647 - DNA, 1720 bp, Homo sapiens
  Payload ID: 13210
  Gene Symbol: PRAMEF5
  Gene Name: PRAME family member 5
  Uniprot ID: Q5TYX0
  ENST ID: ENST00000622421
  CDS Start-End: 87-1517
agcctggagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccatgggtgcttcctcaatgccaagaggaacaaaaaaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttcctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaaggaaaggtgatcaagcaggggcaggacttgggggaagtgttgccatggattcgatgggactttggggacct

SEQ ID NO: 168648 - DNA, 1855 bp, Homo sapiens
  Payload ID: 13210
  Gene Symbol: PRAMEF5
  Gene Name: PRAME family member 5
  Uniprot ID: Q5TYX0
  ENST ID: ENST00000621481
  CDS Start-End: 101-1531
acccaaagtcttcaagcctggagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccatgggtgcttcctcaatgccaagaggaacaaaaaaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttcctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaaggaaaggtgatcaagcaggggcaggacttgggggaagtgttgccatggattcgatgggactttggggacctgtgtcctgtagagtggaaaatgggaatttgaatgtctagagtggaggcttgagaatacttgagggagttactcttggatgcatggttgtaaagaaacaatcagaaataaaggaaaactgag

SEQ ID NO: 168649 - DNA, 1720 bp, Homo sapiens; identical to SEQ ID NO: 168647
  Payload ID: 13210
  Gene Symbol: PRAMEF5
  Gene Name: PRAME family member 5
  Uniprot ID: Q5TYX0
  ENST ID: ENST00000633074
  CDS Start-End: 87-1517

SEQ ID NO: 168650 - DNA, 1720 bp, Homo sapiens
  Payload ID: 13211
  Gene Symbol: PRAMEF6
  Gene Name: PRAME family member 6
  Uniprot ID: Q5VXH4
  ENST ID: ENST00000376189
  CDS Start-End: 87-1517
agcctggagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccgtgggtgcttcctcaatgccaagaggaacaaaacaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttgctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaagggaaggtgatcaagcaggggcaggacttgggggaagtgttgccatggattcgatgggactttggggacct

SEQ ID NO: 168651 - DNA, 1720 bp, Homo sapiens
  Payload ID: 13211
  Gene Symbol: PRAMEF6
  Gene Name: PRAME family member 6
  Uniprot ID: Q5VXH4
  ENST ID: ENST00000415464
  CDS Start-End: 87-1517
agcctagagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccgtgggtgcttcctcaatgccaagaggaacaaaacaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttgctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaagggaaggtgatcaagcaggggcaggacttgggggaagtgttgccatggattcgatgggactttggggacct

SEQ ID NO: 168652 - DNA, 1600 bp, Homo sapiens
  Payload ID: 13211
  Gene Symbol: PRAMEF6
  Gene Name: PRAME family member 6
  ENST ID: ENST00000613225
  CDS Start-End: 100-1530
acccaaagtcttcaagcctggagttcctgcctggttcttcctgaggtctgagcaccttctaaactacatccagatctggtaagtcactaatttctgaagatgagcatccggactccacccagactcctggagcttgcggggcggagcctgctgagggaccaagccttggccatgtccaccctggaggagctgcccacagaacttttccccccactgttcatggaggccttcagcaggagatgctgtgaggccctgaagctgatggtgcaggcctggcccttccgccgcctccctctgaggcctctgataaagatgccttgtctggaggccttccaagctgtgctcgatgggcttgatgcactgcttacccaaggggtttgtcccaggaggtggaaacttcaagtgctggatttacaggatgtctgtgagaacttctggatggtttggtctgaagctatggcccgtgggtgcttcctcaatgccaagaggaacaaaacaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttgctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtctt

SEQ ID NO: 168653 - DNA, 1720 bp, Homo sapiens; identical to SEQ ID NO: 168650
  Payload ID: 13211
  Gene Symbol: PRAMEF6
  Gene Name: PRAME family member 6
  ENST ID: ENST00000632295
  CDS Start-End: 87-1517

SEQ ID NO: 168654 - DNA, 1600 bp, Homo sapiens; identical to SEQ ID NO: 168652
  Payload ID: 13211
  Gene Symbol: PRAMEF6
  Gene Name: PRAME family member 6
  ENST ID: ENST00000633076
  CDS Start-End: 100-1530

SEQ ID NO: 168655 - DNA, 1720 bp, Homo sapiens; identical to SEQ ID NO: 168651
  Payload ID: 13211
  Gene Symbol: PRAMEF6
  Gene Name: PRAME family member 6
  ENST ID: ENST00000632388
  CDS Start-End: 87-1517

SEQ ID NO: 168656 - DNA, 1560 bp, Homo sapiens
  Payload ID: 13212
  Gene Symbol: PRAMEF7
  Gene Name: PRAME family member 7
  Uniprot ID: Q5VXH5
  ENST ID: ENST00000330881
  CDS Start-End: 69-1493
tttggcctgagagtgatgccttttctctggatttgtcctctagagttttcccttgcagattcatcaagatgagcatcagggccccacccagactcctggagctggcaaggcagaggctgctgagggaccaggccttggccatctccaccatggaggagctgcccagggagctcttccccacgctgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcagacttgaagcatctctcttggtgcccgagcatccgtcaattaaaggagctggacctgaggggtgtcacgctgacccatttcagccctgagcccctcacaggtctgctggagcaagctgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggtgctctctgctgggggagatttgctgaacttggggctgagctgatgaacacactgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggcc

SEQ ID NO: 168657 - DNA, 1592 bp, Homo sapiens
  Payload ID: 13212
  Gene Symbol: PRAMEF7
  Gene Name: PRAME family member 7
  ENST ID: ENST00000355096
  CDS Start-End: 99-1523
acccaaagccctggtgcctggaactactgcttgattctctgagagatcccagcaccctacaaactgagtccagatctggtaagtcaccacctccttagatgagcatcagggccccacccagactcctggagctggcaaggcagaggctgctgagggaccaggccttggccatctccaccatggaggagctgcccagggagctcttccccacgctgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcagacttgaagcatctctcttggtgcccgagcatccgtcaattaaaggagctggacctgaggggtgtcacgctgacccatttcagccctgagcccctcacaggtctgctggagcaagctgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggtgctctctgctgggggagatttgctgaacttggggctgagctgatgaacacactgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggccat

SEQ ID NO: 168658 - DNA, 1592 bp, Homo sapiens; identical to SEQ ID NO: 168657
  Payload ID: 13212
  Gene Symbol: PRAMEF7
  Gene Name: PRAME family member 7
  ENST ID: ENST00000616979
  CDS Start-End: 99-1523

SEQ ID NO: 168659 - DNA, 1560 bp, Homo sapiens; identical to SEQ ID NO: 168656
  Payload ID: 13212
  Gene Symbol: PRAMEF7
  Gene Name: PRAME family member 7
  ENST ID: ENST00000633146
  CDS Start-End: 69-1493

SEQ ID NO: 168660 - DNA, 1844 bp, Homo sapiens
  Payload ID: 13213
  Gene Symbol: PRAMEF8
  Gene Name: PRAME family member 8
  Uniprot ID: Q5VWM4
  ENST ID: ENST00000357367
  CDS Start-End: 84-1508
gaactactgcttgattctctgagagatcccagcaccctacaaactgagtccagatctgagttttcccttgcagattcatcaagatgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacgctgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggagctctctgctgggggagatttgctgaacttggggctgagctgatgaacacactgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggccatgagtgcatgttaaagggagcacagacccatcgtttcaaatgcctcctcagtgtgaatgggaaaggaatgaggatgcaggaggggcaggactgggggaaaagttgacttggagtggatgggctctttagagacctgtgtcccagagaatcagaaatgggaatctgaattgctagagtgagaatcagggaggagagacacatgagagggttacccctgcacagatggttgtaaagtaacagtcagaaataaagggaaactgagtggaaa

SEQ ID NO: 168661 - DNA, 1560 bp, Homo sapiens
  Payload ID: 13213
  Gene Symbol: PRAMEF8
  Gene Name: PRAME family member 8
  Uniprot ID: Q5VWM4
  ENST ID: ENST00000611408
  CDS Start-End: 69-1493
tttggcctgagagtgatgccttttctctggatttgtcctctagagttttcccttgcagattcatcaagatgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacgctgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggagctctctgctgggggagatttgctgaacttggggctgagctgatgaacacactgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggcc

SEQ ID NO: 168662 - DNA, 1558 bp, Homo sapiens
  Payload ID: 13213
  Gene Symbol: PRAMEF8
  Gene Name: PRAME family member 8
  Uniprot ID: Q5VWM4
  ENST ID: ENST00000616484
  CDS Start-End: 67-1491
tctgagagatcccagcaccctacaaactgagtccagatctgagttttcccttgcagattcatcaagatgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacgctgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggagctctctgctgggggagatttgctgaacttggggctgagctgatgaacacactgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggcc

SEQ ID NO: 168663 - DNA, 1592 bp, Homo sapiens
  Payload ID: 13213
  Gene Symbol: PRAMEF8
  Gene Name: PRAME family member 8
  Uniprot ID: Q5VWM4
  ENST ID: ENST00000614831
  CDS Start-End: 99-1523
acccaaagccctggtgcctggaactactgcttgattctctgagagatcccagcaccctacaaactgagtccagatctggtaagtcaccacctccttagatgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacgctgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggagctctctgctgggggagatttgctgaacttggggctgagctgatgaacacactgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggccat

SEQ ID NO: 168664 - DNA, 1706 bp, Homo sapiens
  Payload ID: 13213
  Gene Symbol: PRAMEF8
  Gene Name: PRAME family member 8
  Uniprot ID: Q5VWM4
  ENST ID: ENST00000621519
  CDS Start-End: 79-1503
ggtgatcatatttggcctgagagtgatgccttttctctggatttgtcctctagagttttcccttgcagattcatcaagatgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacgctgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggagctctctgctgggggagatttgctgaacttggggctgagctgatgaacacactgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggccatgagtgcatgttaaagggagcacagacccatcgtttcaaatgcctcctcagtgtgaatgggaaaggaatgaggatgcaggaggggcaggactgggggaaaagttgacttggagtggatgggctctttagagacct

SEQ ID NO: 168665 - DNA, 1592 bp, Homo sapiens; identical to SEQ ID NO: 168663
  Payload ID: 13213
  Gene Symbol: PRAMEF8
  Gene Name: PRAME family member 8
  ENST ID: ENST00000631760
  CDS Start-End: 99-1523

SEQ ID NO: 168666 - DNA, 1706 bp, Homo sapiens; identical to SEQ ID NO: 168664
  Payload ID: 13213
  Gene Symbol: PRAMEF8
  Gene Name: PRAME family member 8
  ENST ID: ENST00000632952
  CDS Start-End: 79-1503

SEQ ID NO: 168667 - DNA, 1844 bp, Homo sapiens; identical to SEQ ID NO: 168660
  Payload ID: 13213
  Gene Symbol: PRAMEF8
  Gene Name: PRAME family member 8
  ENST ID: ENST00000632222
  CDS Start-End: 84-1508

SEQ ID NO: 168668 - DNA, 1863 bp, Homo sapiens
  Payload ID: 13214
  Gene Symbol: PRAMEF9
  Gene Name: PRAME family member 9
  ENST ID: ENST00000612758
  CDS Start-End: 95-1531
acccaaagtcttcaagcctggagttcctgcctggttcttcctgaggtctgagcaccttctaaactacatccagatctgttttccctgcagattcatgaagatgagcatccggactccacccagactcctggagcttgcggggcggagcctgctgagggaccaagccttggccatgtccaccctggaggagctgcccacagaacttttccccccactgttcatggaggccttcagcaggagatgctgtgaggccctgaagctgatggtgcaggcctggcccttccgccgcctccctctgaggcctctgataaagatgccttgtctggaggccttccaagctgtgctcgatgggcttgatgcactgcttacccaaggggtttgtcccaggaggtggaaacttcaagtgctggatttacaggatgtctgtgagaacttctggatggtttggtctgaagctatggcccgtgggtccttcctcaatgccaagaggaacaaaacaccagtgcaggactgtccaaggatgagaggacagcagcccttgactgtgttcgtagaactttggctcaagaacaggactctggatgaatacctcacctacctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctctcacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaagttcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacttggatttagatgactgtggcatcatagactcccaagtcaacgccatcctgcctgccctgagccgctgctttgagctcaatgccttcagcttctgtggaaatcccatctccatggccaccctggagaacctgctgagccacacaatcatactcaaaaacttatgcgtggaggtgtatcctgccccgcgggagagttatggtgctgatggtactctctgctggaacagatttgctcaaattagggctgagctgatgaacagagtgagggacttaaggcaccccaagaggatctttttctgtattgataactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggcaggacttgggggaaatgttgccatggattcgatgggactttggggacctgtatcctgtagagtcgaaaatgggaatctgaatgtctagagtggaattcaggcttgagaatacatgagggagttactcttgcatggatggttgtaaagaaacaatcagaaataaaggaaaactgagcag

SEQ ID NO: 168669 - DNA, 1863 bp, Homo sapiens
  Payload ID: 13214
  Gene Symbol: PRAMEF9
  Gene Name: PRAME family member 9
  ENST ID: ENST00000415919
  CDS Start-End: 95-1531
acccaaagtcttcaagcctggagttcctgcttggttcttcctgaggtctgagcaccttctaaactacatccagatctgttttccctgcagattcatgaagatgagcatccggactccacccagactcctggagctggcggggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggtttgtcccaggaggtggaaacttcaagtgctggatttacaggatgtctgtgagaacttctggatggtttggtctgaagctatggcccgtgggtccttcctcaatgccaagaggaacaaaacaccagtgcaggactgtccaaggatgagaggacagcagcccttgactgtgttcgtagaactttggctcaagaacaggactctggatgaatacctcacctacctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacttggatttagatgactgtggcatcatagactcccaagtcaacgccatcctgcctgccctgagccgctgctttgagctcaatgccttcagcttctgtggaaatcccatctccatggccaccctggagaacctgctgagccacacaatcatactcaaaaacttatgcgtggaggtgtatcctgccccgcgggagagttatggtgctgatggtactctctgctggagcagatttgctcaaattagggctgagctgatgaacagagtgagggacttaaggcaccccaagaggatctttttctgtattgacaactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggcaggacttgggggaaatgttgccatggattcgatgggactttggggacctgtatcctgtagagtcgaaaatgggaatctgaatgtctagagtggaattcaggcttgagaatacatgagggagttactcttgcatggatggttgtaaagaaacaatcagaaataaaggaaaactgagcag

SEQ ID NO: 168670 - DNA, 1863 bp, Homo sapiens; identical to SEQ ID NO: 168669
  Payload ID: 13214
  Gene Symbol: PRAMEF9
  Gene Name: PRAME family member 9
  ENST ID: ENST00000633914
  CDS Start-End: 95-1531

SEQ ID NO: 168671 - DNA, 1865 bp, Homo sapiens; identical to SEQ ID NO: 168615
  Payload ID: 13215
  Gene Symbol:
  Gene Name: PRAMEF9
  ENST ID: ENST00000632181
  CDS Start-End: 95-1531

SEQ ID NO: 168672 - DNA, 1600 bp, Homo sapiens; identical to SEQ ID NO: 168616
  Payload ID: 13215
  Gene Symbol:
  Gene Name: PRAMEF9
  ENST ID: ENST00000633191
  CDS Start-End: 100-1530

SEQ ID NO: 168673 - DNA, 1080 bp, Homo sapiens
  Payload ID: 13216
  Gene Symbol: PTCRA
  Gene Name: pre T-cell antigen receptor alpha
  Uniprot ID: Q6ISU1
  ENST ID: ENST00000304672
  CDS Start-End: 82-927
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagc

SEQ ID NO: 168674 - DNA, 759 bp, Homo sapiens
  Payload ID: 13216
  Gene Symbol: PTCRA
  Gene Name: pre T-cell antigen receptor alpha
  Uniprot ID: Q6ISU1
  ENST ID: ENST00000446507
  CDS Start-End: 82-606
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagc

SEQ ID NO: 168675 - DNA, 1005 bp, Homo sapiens
  Payload ID: 13216
  Gene Symbol: PTCRA
  Gene Name: pre T-cell antigen receptor alpha
  Uniprot ID: Q6ISU1
  ENST ID: ENST00000441198
  CDS Start-End: 82-852
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtcctgtttccttcccttcctcaccagaggctgccacaacaggccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagc

SEQ ID NO: 168676 - DNA, 1125 bp, Homo sapiens
  Payload ID: 13216
  Gene Symbol: PTCRA
  Gene Name: pre T-cell antigen receptor alpha
  ENST ID: ENST00000616441
  CDS Start-End: 82-972
tagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggggctgcgggctcctgcgggctcctgagcggttcctcctcgcagggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagc

SEQ ID NO: 168677 - DNA, 626 bp, Homo sapiens
  Payload ID: 13217
  Gene Symbol: VPREB1
  Gene Name: pre-B lymphocyte 1
  ENST ID: ENST00000302273
  CDS Start-End: 24-458
ggccacaggagtcagagctctgcatgtctgcaccatgtcctgggctcctgtcctgctcatgctgtttgtctactgcacagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagtcgccgcccgaagcgccgaggaggctgagccactcagcatctcctggtcctgcagtgttgctgtaaatccccattggagactgcattagggaattaaagctgcttgtcac

SEQ ID NO: 168678 - DNA, 755 bp, Homo sapiens
  Payload ID: 13217
  Gene Symbol: VPREB1
  Gene Name: pre-B lymphocyte 1
  Uniprot ID: P12018
  ENST ID: ENST00000403807
  CDS Start-End: 140-577
agaaagtctgggatggtagtggccaggaacggggtgtgccacggccccacctctcagagcagggaggaggatgctgggccagcccttggggaccccaggcaccgtggccacaggagtcagagctctgcatgtctgcaccatgtcctgggctcctgtcctgctcatgctgtttgtctactgcacaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagtcgccgcccgaagcgccgaggaggctgagccactcagcatctcctggtcctgcagtgttgctgtaaatccccattggagactgcattagggaattaaagctgcttgtcactttttgctga

SEQ ID NO: 168679 - DNA, 610 bp, Homo sapiens
  Payload ID: 13218
  Gene Symbol: VPREB3
  Gene Name: pre-B lymphocyte 3
  Uniprot ID: Q9UKI3
  ENST ID: ENST00000248948
  CDS Start-End: 106-477
gcatgctctgttgtggtccagtggccttcccagccctgtgccccaaagcacctggagcatatagccttgcagaacttctacttgcctgcctccctgcctctggccatggcctgccggtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaaca

SEQ ID NO: 168680 - DNA, 503 bp, Homo sapiens
  Payload ID: 13218
  Gene Symbol: VPREB3
  Gene Name: pre-B lymphocyte 3
  ENST ID: ENST00000398465
  CDS Start-End: 47-370
tatagccttgcagaacttctacttgcctgcctccctgcctctggccatggcctgccggtgcctcagcttccttctgatggggaccttcctgtcaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaaca

SEQ ID NO: 168681 - DNA, 734 bp, Homo sapiens
  Payload ID: 13219
  Gene Symbol: PBX1
  Gene Name: pre-B-cell leukemia homeobox 1
  ENST ID: ENST00000340699
  CDS Start-End: 225-734
aatgcatatttgcaaaaggattaagccacagatttaagcgccgggagcccatttctgccttgcaaaggagaccggactgaaaaacctaaagccagctctgatttcttttcgccaagtgggaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcag

SEQ ID NO: 168682 - DNA, 1459 bp, Homo sapiens
  Payload ID: 13219
  Gene Symbol: PBX1
  Gene Name: pre-B-cell leukemia homeobox 1
  Uniprot ID: P40424
  ENST ID: ENST00000367897
  CDS Start-End: 1-1044
atggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtc

SEQ ID NO: 168683 - DNA, 6636 bp, Homo sapiens
  Payload ID: 13219
  Gene Symbol: PBX1
  Gene Name: pre-B-cell leukemia homeobox 1
  Uniprot ID: P40424
  ENST ID: ENST00000420696
  CDS Start-End: 189-1481
atcctcccaccatcctctaaagaggcaaagggattttttttttcttttggtcttcttttttcccccttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaatccatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgcaaaaaaaaat

SEQ ID NO: 168684 - DNA, 6175 bp, Homo sapiens
  Payload ID: 13219
  Gene Symbol: PBX1
  Gene Name: pre-B-cell leukemia homeobox 1
  ENST ID: ENST00000540236
  CDS Start-End: 2-1030
agttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaatccatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgc

SEQ ID NO: 168685 - DNA, 3225 bp, Homo sapiens
  Payload ID: 13219
  Gene Symbol: PBX1
  Gene Name: pre-B-cell leukemia homeobox 1
  ENST ID: ENST00000560641
  CDS Start-End: 402-1379
agagtactctcctctgcttctacctccgggaaccccgttaccccccagcccacacaccaccaccccagttttgggtggggagaaggcaaagagtgggaagataagaacacatgtagagatgataaaatgtcattggctccaagagacaagcttccgaaatccatggtggttgaagaacatcaaagaggagcaattatttcagtcattagggcagttccacctgttctaattgaacatttttaggatgtagaagatgcatcatacattggtatctattcagaaggtggggacatctgctgtctgtcatgtatctgggagatgtttatctcaacaggaggcaataataatatgttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaa

SEQ ID NO: 168686 - DNA, 630 bp, Homo sapiens
  Payload ID: 13219
  Gene Symbol: PBX1
  Gene Name: pre-B-cell leukemia homeobox 1
  ENST ID: ENST00000559578
  CDS Start-End: 152-630
gaattaaatttgaaaacacacagaccgagaggcagacagttcctaggctgtggtcgttgcatggattttacaaaactgttaacctacacctttggctttgctgtgttcattgtcctgggaagaattaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctgga

SEQ ID NO: 168687 - DNA, 572 bp, Homo sapiens
  Payload ID: 13219
  Gene Symbol: PBX1
  Gene Name: pre-B-cell leukemia homeobox 1
  ENST ID: ENST00000482110
  CDS Start-End: 187-572
gataatgaactagcacatgggctgcatcaggaagccctggggacctcgcagaagttgagagtgtggagtgggagaatgggaggagtaatatattaaccttactgatacacaaagttgctccttctttttcttgcagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcg

SEQ ID NO: 168688 - DNA, 2866 bp, Homo sapiens
  Payload ID: 13219
  Gene Symbol: PBX1
  Gene Name: pre-B-cell leukemia homeobox 1
  ENST ID: ENST00000559240
  CDS Start-End: 1-1020
atggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaa

SEQ ID NO: 168689 - DNA, 454 bp, Homo sapiens
  Payload ID: 13219
  Gene Symbol: PBX1
  Gene Name: pre-B-cell leukemia homeobox 1
  ENST ID: ENST00000559560
  CDS Start-End: 162-454
aaagaacagcaggagacaagtggtgagagcagctcccacaatgctgtgacagtccctttatcttaggacttttaccaaagaattaaccccagggcaagcgatggcagcaagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcat

SEQ ID NO: 168690 - DNA, 577 bp, Homo sapiens
  Payload ID: 13219
  Gene Symbol: PBX1
  Gene Name: pre-B-cell leukemia homeobox 1
  ENST ID: ENST00000558837
  CDS Start-End: 162-577
gagtgtctgatttctcagatatgaccatatccagttctgggctccagccctgacctgttccttggctatcagaactatcataaggccagatcagcttaactcatctccaagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagc

SEQ ID NO: 168691 - DNA, 834 bp, Homo sapiens
  Payload ID: 13219
  Gene Symbol: PBX1
  Gene Name: pre-B-cell leukemia homeobox 1
  ENST ID: ENST00000485769
  CDS Start-End: 432-644
ctgacggggctgctggagtttgcagagacacggaggaggagagagcctgtgctttgcctgccgccgcggctgggggagatctggcttttgcaacagcccaccccctttgagatcactctggcccggagtgggggtggggggcagcggggggtggggggggaaagtttgcattgcaatccccctgccttcctctcctttctcccgatcaatgcatatttgcaaaaggattaagccacagatttaagcgccgggagcccatttctgccttgcaaaggagaccggactgaaaaacctaaagccagctctgatttcttttcgccaagtgggaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagcaactacatggcggaggagtaaaatttgaaggagcgttgttatcgaaagtgtaatcgcccatgccgagatgtggctgtgtacatatttgtgtgtgtgtgtgtgaatataggggtattcatttatatccacacaaacacacaggcatgccgaaaatactgccaactgatccaaaagcggccctcggcactttttactgctttaaaaaagtatc

SEQ ID NO: 168692 - DNA, 6062 bp, Homo sapiens
  Payload ID: 13219
  Gene Symbol: PBX1
  Gene Name: pre-B-cell leukemia homeobox 1
  ENST ID: ENST00000612123
  CDS Start-End: 2-781
agttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaatccatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgc

SEQ ID NO: 168693 - DNA, 1769 bp, Homo sapiens
  Payload ID: 13219
  Gene Symbol: PBX1
  Gene Name: pre-B-cell leukemia homeobox 1
  Uniprot ID: P40424
  ENST ID: ENST00000627490
  CDS Start-End: 80-1342
ataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaatccatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttg

SEQ ID NO: 168694 - DNA, 3205 bp, Homo sapiens
  Payload ID: 13220
  Gene Symbol: PBX2
  Gene Name: pre-B-cell leukemia homeobox 2
  Uniprot ID: P40425
  ENST ID: ENST00000375050
  CDS Start-End: 272-1564
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtctttttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttt

SEQ ID NO: 168695 - DNA, 3210 bp, Homo sapiens
  Payload ID: 13220
  Gene Symbol: PBX2
  Gene Name: pre-B-cell leukemia homeobox 2
  Uniprot ID: P40425
  ENST ID: ENST00000383270
  CDS Start-End: 272-1564
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctaggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttgttggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggg

SEQ ID NO: 168696 - DNA, 3202 bp, Homo sapiens
  Payload ID: 13220
  Gene Symbol: PBX2
  Gene Name: pre-B-cell leukemia homeobox 2
  Uniprot ID: P40425
  ENST ID: ENST00000431537
  CDS Start-End: 272-1564
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttt

SEQ ID NO: 168697 - DNA, 3211 bp, Homo sapiens
  Payload ID: 13220
  Gene Symbol: PBX2
  Gene Name: pre-B-cell leukemia homeobox 2
  Uniprot ID: P40425
  ENST ID: ENST00000433552
  CDS Start-End: 272-1564
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaactttttttttttttaaagaaagaaaaagaaaccctgggatccatctgttttttttgttgttgttgttgtttttgttgttggtggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggg

SEQ ID NO: 168698 - DNA, 3210 bp, Homo sapiens
  Payload ID: 13220
  Gene Symbol: PBX2
  Gene Name: pre-B-cell leukemia homeobox 2
  Uniprot ID: P40425
  ENST ID: ENST00000453961
  CDS Start-End: 272-1564
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttgttggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctggg

SEQ ID NO: 168699 - DNA, 3210 bp, Homo sapiens
  Payload ID: 13220
  Gene Symbol: PBX2
  Gene Name: pre-B-cell leukemia homeobox 2
  Uniprot ID: P40425
  ENST ID: ENST00000453487
  CDS Start-End: 272-1564
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttggtggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaatcaaaatgcagttttaaataaagaaatttcttttttccctggg

SEQ ID NO: 168700 - DNA, 3202 bp, Homo sapiens
  Payload ID: 13220
  Gene Symbol: PBX2
  Gene Name: pre-B-cell leukemia homeobox 2
  Uniprot ID: P40425
  ENST ID: ENST00000420432
  CDS Start-End: 272-1564
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttggtggtggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttt

SEQ ID NO: 168701 - DNA, 2755 bp, Homo sapiens
  Payload ID: 13221
  Gene Symbol: PBX3
  Gene Name: pre-B-cell leukemia homeobox 3
  Uniprot ID: P40426
  ENST ID: ENST00000342287
  CDS Start-End: 110-1165
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 168702 - DNA, 1130 bp, Homo sapiens
  Payload ID: 13221
  Gene Symbol: PBX3
  Gene Name: pre-B-cell leukemia homeobox 3
  ENST ID: ENST00000373482
  CDS Start-End: 1-282
atggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaag

SEQ ID NO: 168703 - DNA, 2902 bp, Homo sapiens
  Payload ID: 13221
  Gene Symbol: PBX3
  Gene Name: pre-B-cell leukemia homeobox 3
  ENST ID: ENST00000373487
  CDS Start-End: 81-1448
tcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacagagtcttgtaaaggatccaaaagaaagagggagcaaaggttctgacatccagccaactagcgtggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 168704 - DNA, 2775 bp, Homo sapiens
  Payload ID: 13221
  Gene Symbol: PBX3
  Gene Name: pre-B-cell leukemia homeobox 3
  Uniprot ID: P40426
  ENST ID: ENST00000373489
  CDS Start-End: 17-1321
gcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 168705 - DNA, 950 bp, Homo sapiens
  Payload ID: 13221
  Gene Symbol: PBX3
  Gene Name: pre-B-cell leukemia homeobox 3
  ENST ID: ENST00000373492
  CDS Start-End: 1-282
atggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaa

SEQ ID NO: 168706 - DNA, 2789 bp, Homo sapiens
  Payload ID: 13221
  Gene Symbol: PBX3
  Gene Name: pre-B-cell leukemia homeobox 3
  Uniprot ID: P40426
  ENST ID: ENST00000447726
  CDS Start-End: 256-1335
ctctgcacaggagcggacgcgggagcccctccgcacccgtcccctcccccgggtcgccttcgcctgcccccggggcgaggctccccgcgcgggttcgcgtcgcgtctgcagtggccgaggctgctgcctgccgggcagatgggtccgccttgttccggctgcagctttcgccgccggggcttgctggctgtcgggaactagtcaactggagtttttgttgacttcccacggaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 168707 - DNA, 528 bp, Homo sapiens
  Payload ID: 13221
  Gene Symbol: PBX3
  Gene Name: pre-B-cell leukemia homeobox 3
  ENST ID: ENST00000428092
  CDS Start-End: 1-528
ttgtttcctggagaataagtcaggagcaattacatgtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactc

SEQ ID NO: 168708 - DNA, 875 bp, Homo sapiens
  Payload ID: 13221
  Gene Symbol: PBX3
  Gene Name: pre-B-cell leukemia homeobox 3
  ENST ID: ENST00000491787
  CDS Start-End: 394-875
cgcagtcggccggcctcctctgcacaggagcggacgcgggagcccctccgcacccgtcccctcccccgggtcgccttcgcctgcccccggggcgaggctccccgcgcgggttcgcgtcgcgtctgcagtggccgaggctgctgcctgccgggcagatgggtccgccttgttccggctgcagctttcgccgccggggcttgctggctgtcgggaactagtcaactggagtttttgttgacttcccacggttcaaaagggccttccagaatggggggctggaattaaatcttgggtctaacttaaaggaaggcgccatattattccataggtgatgctaatacctttgtgtttcgttatttgttttttaggaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccag

SEQ ID NO: 168709 - DNA, 1724 bp, Homo sapiens
  Payload ID: 13222
  Gene Symbol: PBX4
  Gene Name: pre-B-cell leukemia homeobox 4
  Uniprot ID: Q9BYU1
  ENST ID: ENST00000251203
  CDS Start-End: 288-1412
agaagtgccgttgcctcggcaaccccaaacccagtccaagcccggagagggggaagttcggggcgagtcccgggggcggtgcgtggcgccggttggctgacggagatgaaggggcgtgtctgtaggcggtgcaatacacgggttggctggcgatagcggcggtgggcgtggcttaggcgcgagcgagagcgggcgcggcgctcaggcagcggcggttggctgcggcgccagtggtagtgctccaggctcgacggcaccctcacagcgcccgcccggccctgccgctcatggccgccccgccgcgccccgcgccatcgccccccgccccgcggcgcctcgacacgagcgacgtcctgcagcagatcatggccatcaccgaccagagcctggacgaggcacaggccagaaagcatgctctgaattgccatcggatgaagcctgctctgttcagcgtgctctgtgagatcaaggaaaagacagtggtaagcatccgtggcattcaagacgaagatccccctgacgcccagctcctgaggctggataacatgctgctggctgagggcgtgtgcaggcccgagaagagaggaagaggaggagcggtggccagggccggcacagcaacaccaggtggctgtccaaatgacaatagcattgagcactctgactacagggccaagctgtcccagatccgacagatttaccactctgagctagagaaatatgaacaggcctgtcgtgagttcaccacgcacgtcaccaacctcctccaggagcagagcaggatgaggcctgtctcccctaaggagattgagcgcatggtcggcgccattcacggcaagttcagcgccatccagatgcagttgaagcagagcacctgtgaggcagtgatgaccctgcgttcgcggctgctcgatgccaggcgcaagcggcggaatttcagcaagcaggcgacggaagtgctgaatgagtatttttactcccatctgaacaacccttaccccagcgaagaagccaaagaagagctggccaggaagggcggcctcaccatctcccaggtctctaactggtttggcaacaaaagaatccggtataaaaagaacatggggaagtttcaagaagaggctaccatttacacgggtaaaacggctgtggataccacggaagttggggtcccagggaaccacgccagctgcctgtcaacacctagctccggctcctctggacccttcccgctgcccagcgctggggacgccttcctcaccctgcggactctggcctctctccagcctcctcctgggggaggctgcctgcagtcccaggcccagggtagctggcagggggccaccccccaacctgcaactgcctcacctgctggagaccctggcagcatcaactccagtacatctaattaagtttgggggataagcaggaaagagcgctgcgtgagctgccatgtatcgccagccgttgctttgttactgaacgtgccgccgacgacctcagaaaacccagatgggtggtggtgcccatgagcccctgctcctcagccaggcccgtggcgccggctcatgtgtctgctgcgactcgagatggcctgaaacgccactcattctcccacttcagttcgtttttttgacagtaattttatggtaacgctatgaattgaattgtctgttctaggactgggcacagattttcccattaaaatttttgacttattttaa

SEQ ID NO: 168710 - DNA, 1034 bp, Homo sapiens
  Payload ID: 13222
  Gene Symbol: PBX4
  Gene Name: pre-B-cell leukemia homeobox 4
  ENST ID: ENST00000558222
  CDS Start-End: 53-403
agtgctccaggctcgacggcaccctcacagcgcccgcccggccctgccgctcatggccgccccgccgcgccccgcgccatcgccccccgccccgcggcgcctcgacacgagcgacgtcctgcagcagatcatggccatcaccgaccagagcctggacgaggcacaggccagaaagcatgctctgaattgccatcggatgaagcctgctctgttcagcgtgctctgtgagatcaaggaaaagacagtggtaagcatccgtggcattcaagacgaagatccccctgacgcccagctcctgaggctggataacatgctgctggctgagggcgtgtgcaggcccgagaagagaggaagaggaggagcggtggccagggccggcacagcaacaccaggcctgtcgtgagttcaccacgcacgtcaccaacctcctccaggagcagagcaggatgaggcctgtctcccctaaggagattgagcgcatggtcggcgccattcacggcaagttcagcgccatccagatgcagttgaagcagagcacctgtgaggcagtgatgaccctgcgttcgcggctgctcgatgccaggcgcaagcggcggaatttcagcaagcaggcgacggaagtgctgaatgagtatttttactcccatctgaacaacccttaccccagcgaagaagccaaagaagagctggccaggaagggcggcctcaccatctcccaggtctctaactggtttggcaacaaaagaatccggtataaaaagaacatggggaagtttcaagaagaggctaccatttacacgggtaaaacggctgtggataccacggaagttggggtcccagggaaccacgccagctgcctgtcaacacctagctccggtgagtgaggctggcccagggacagtcatctgtacccatgtggacggccactgagctgcatctggggaggccacagtgggaccacatctcccttcccccagtggtcaactctgtgtaactctttcttctgtttcaactgtgagagttctgttcctctt

SEQ ID NO: 168711 - DNA, 1416 bp, Homo sapiens
  Payload ID: 13222
  Gene Symbol: PBX4
  Gene Name: pre-B-cell leukemia homeobox 4
  ENST ID: ENST00000557978
  CDS Start-End: 65-415
ggcgccagtggtagtgctccaggctcgacggcaccctcacagcgcccgcccggccctgccgctcatggccgccccgccgcgccccgcgccatcgccccccgccccgcggcgcctcgacacgagcgacgtcctgcagcagatcatggccatcaccgaccagagcctggacgaggcacaggccagaaagcatgctctgaattgccatcggatgaagcctgctctgttcagcgtgctctgtgagatcaaggaaaagacagtggtaagcatccgtggcattcaagacgaagatccccctgacgcccagctcctgaggctggataacatgctgctggctgagggcgtgtgcaggcccgagaagagaggaagaggaggagcggtggccagggccggcacagcaacaccaggcctgtcgtgagttcaccacgcacgtcaccaacctcctccaggagcagagcaggatgaggcctgtctcccctaaggagattgagcgcatggtcggcgccattcacggcaagttcagcgccatccagatgcagttgaagcagagcacctgtgaggcagtgatgaccctgcgttcgcggctgctcgatgccaggtcagggcctgcgcaagcggcggaatttcagcaagcaggcgacggaagtgctgaatgagtatttttactcccatctgaacaacccttaccccagcgaagaagccaaagaagagctggccaggaagggcggcctcaccatctcccaggtctctaactggtttggcaacaaaagaatccggtataaaaagaacatggggaagtttcaagaagaggctaccatttacacgggtaaaacggctgtggataccacggaagttggggtcccagggaaccacgccagctgcctgtcaacacctagctccggctcctctggacccttcccgctgcccagcgctggggacgccttcctcaccctgcggactctggcctctctccagcctcctcctgggggaggctgcctgcagtcccaggcccagggtagctggcagggggccaccccccaacctgcaactgcctcacctgctggagaccctggcagcatcaactccagtacatctaattaagtttgggggataagcaggaaagagcgctgcgtgagctgccatgtatcgccagccgttgctttgttactgaacgtgccgccgacgacctcagaaaacccagatgggtggtggtgcccatgagcccctgctcctcagccaggcccgtggcgccggctcatgtgtctgctgcgactcgagatggcctgaaacgccactcattctcccacttcagttcgtttttttgacagtaattttatggtaacgctatgaattgaattgtctgttctaggactgggcacagattttcccattaaaatttttgacttattttaattccga

SEQ ID NO: 168712 - DNA, 1175 bp, Homo sapiens
  Payload ID: 13223
  Gene Symbol: PBXIP1
  Gene Name: pre-B-cell leukemia homeobox interacting protein 1
  ENST ID: ENST00000368460
  CDS Start-End: 80-1027
ctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggtgggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaaggtttgggccagggctggcatacctgttccacatggtacatgaaacatacatggtatcacctgtgattgattggtgtggtctgcctggagcactgtgtggaaaaggatttaaagaacatgccaggtgccatgatcagttaacactgtt

SEQ ID NO: 168713 - DNA, 3212 bp, Homo sapiens
  Payload ID: 13223
  Gene Symbol: PBXIP1
  Gene Name: pre-B-cell leukemia homeobox interacting protein 1
  Uniprot ID: Q96AQ6
  ENST ID: ENST00000368463
  CDS Start-End: 73-2268
aagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaa

SEQ ID NO: 168714 - DNA, 3144 bp, Homo sapiens
  Payload ID: 13223
  Gene Symbol: PBXIP1
  Gene Name: pre-B-cell leukemia homeobox interacting protein 1
  Uniprot ID: Q96AQ6
  ENST ID: ENST00000368465
  CDS Start-End: 88-2196
aaagggaagcctgcaacaagttaagctgaagaccgaagcaagagctggttcagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaatgcc

SEQ ID NO: 168715 - DNA, 853 bp, Homo sapiens
  Payload ID: 13223
  Gene Symbol: PBXIP1
  Gene Name: pre-B-cell leukemia homeobox interacting protein 1
  ENST ID: ENST00000490230
  CDS Start-End: 92-535
acaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagtcacctcactgccctgtccctgtcctttcccctagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgg

SEQ ID NO: 168716 - DNA, 2202 bp, Homo sapiens
  Payload ID: 13224
  Gene Symbol: PRAME
  Gene Name: preferentially expressed antigen in melanoma
  Uniprot ID: P78395
  ENST ID: ENST00000398741
  CDS Start-End: 308-1837
aatgtagggaaagcagggcggagtcctctgcaggctcgggggaggggaggggcgtgaatgcgtggatttctgtggagagtggaaacacggggagtcgaggggagcatgcgcgggcctcagaaagttctgggaaaccgactcccgggagcagggaggaacgcgcgctccagagacaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacgaccttaagcttctacgggaattccatctccatatctgccctgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaattagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttgggggtaggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagc

SEQ ID NO: 168717 - DNA, 2196 bp, Homo sapiens
  Payload ID: 13224
  Gene Symbol: PRAME
  Gene Name: preferentially expressed antigen in melanoma
  Uniprot ID: P78395
  ENST ID: ENST00000398743
  CDS Start-End: 301-1830
gttttgcatacagtccctgttgactctagtgccccctgctggccccagacgcgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacgaccttaagcttctacgggaattccatctccatatctgccctgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaattagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttgggggtaggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 168718 - DNA, 740 bp, Homo sapiens
  Payload ID: 13224
  Gene Symbol: PRAME
  Gene Name: preferentially expressed antigen in melanoma
  ENST ID: ENST00000406503
  CDS Start-End: 384-731
gtacagctcccccgcagccagaagccgggcctgcagcgcctcagcaccgctccgggacaccccacccgcttcccaggcgtgacctgtcaacagcaacttcgcggtgtggtgaactctctgaggaaaaaccccaggaaacactggtgctcaggtttggagccagagatttgcactgaaagggcgggattgagtcgccagttgtcagtttcctcagcagtatttgcggaggttttcacaggaggccgttgcttcgtaaatattatacatgtattcttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggtaagggtgacct

SEQ ID NO: 168719 - DNA, 2179 bp, Homo sapiens
  Payload ID: 13224
  Gene Symbol: PRAME
  Gene Name: preferentially expressed antigen in melanoma
  Uniprot ID: P78395
  ENST ID: ENST00000405655
  CDS Start-End: 287-1816
aatgtagggaaagcagggcggagtcctctgcaggctcgggggaggggaggggcgtgaatgcgtggatttctgtggagagtggaaacacggggagtcgaggggagcatgcgcgggcctcagaaagttctgggaaaccgactcccgggagcagggaggaacgcgcgctccagagacaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacgaccttaagcttctacgggaattccatctccatatctgccctgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaattagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttgggggtaggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaa

SEQ ID NO: 168720 - DNA, 567 bp, Homo sapiens
  Payload ID: 13224
  Gene Symbol: PRAME
  Gene Name: preferentially expressed antigen in melanoma
  ENST ID: ENST00000403441
  CDS Start-End: 309-567
ctcgactctctgggcgacctcactggatctcgtgagattttgccctggaaggactgagaaacggggattggtcagaccaggctgcccagccccccggtccccaccgccgccccccccgccccacgcagcggctagggcgcttagctgagccattgtctcgttctttccttccagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctga

SEQ ID NO: 168721 - DNA, 2057 bp, Homo sapiens
  Payload ID: 13224
  Gene Symbol: PRAME
  Gene Name: preferentially expressed antigen in melanoma
  Uniprot ID: P78395
  ENST ID: ENST00000402697
  CDS Start-End: 228-1757
gagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacgaccttaagcttctacgggaattccatctccatatctgccctgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaattagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttgggggtaggcagatgttgacttgaggagttaatgtgatctttggggagatacatcttatagagttagaaatagaatctgaatttctaaagggagattctggcttgggaagtacatgta

SEQ ID NO: 168722 - DNA, 581 bp, Homo sapiens
  Payload ID: 13224
  Gene Symbol: PRAME
  Gene Name: preferentially expressed antigen in melanoma
  ENST ID: ENST00000442481
  CDS Start-End: 147-341
ctttccttccagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggcgtggagttgaaaggggaggtatgcccagaaaggcctgtaatagcttcagaggggccagaggagggacccagaggccatggagtcaatgttgtggtcttcccagaggtctgggcagatggcttctgcaccacagctgggtctgggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttca

SEQ ID NO: 168723 - DNA, 566 bp, Homo sapiens
  Payload ID: 13224
  Gene Symbol: PRAME
  Gene Name: preferentially expressed antigen in melanoma
  ENST ID: ENST00000438888
  CDS Start-End: 1-566
agacgcaaaagcccacacttccagtggtgtcagagagtatgagctccaggaggctttgatctcactgccccatgggcttgggccattagggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagca

SEQ ID NO: 168724 - DNA, 891 bp, Homo sapiens
  Payload ID: 13224
  Gene Symbol: PRAME
  Gene Name: preferentially expressed antigen in melanoma
  ENST ID: ENST00000439106
  CDS Start-End: 287-891
cgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacgaggccgttgcttcgtaaatattatacatgtattcttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaa

SEQ ID NO: 168725 - DNA, 705 bp, Homo sapiens
  Payload ID: 13224
  Gene Symbol: PRAME
  Gene Name: preferentially expressed antigen in melanoma
  ENST ID: ENST00000420709
  CDS Start-End: 248-705
cgtggatttctgtggagagtggaaacacggggagtcgaggggagcatgcgcgggcctcagaaagttctgggaaaccgactcccgggagcagggaggaacgcgcgctccagagacaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctca

SEQ ID NO: 168726 - DNA, 2202 bp, Homo sapiens; identical to SEQ ID NO: 168716
  Payload ID: 13224
  Gene Symbol: PRAME
  Gene Name: preferentially expressed antigen in melanoma
  Uniprot ID: P78395
  ENST ID: ENST00000539862
  CDS Start-End: 308-1837

SEQ ID NO: 168727 - DNA, 2758 bp, Homo sapiens
  Payload ID: 13224
  Gene Symbol: PRAME
  Gene Name: preferentially expressed antigen in melanoma
  Uniprot ID: P78395
  ENST ID: ENST00000543184
  CDS Start-End: 864-2393
cgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacgtaagttcgagccctgattcctccgcttccccgcagggtgaccttgggcttgtgcccccagcaccacccctgtcccgggtccctgttttctctctggaaatgggttgaagaccaaagaaaataatgtgcgccacttgggtcaccccgggccgcctgccccggaaaattggccccagttgaggagttgtggctgtaaggatgccttgaaccgaggcggcggtgctcgtggttggagctctccagggtgggtgcgcatttgtaatgcggtggatgctctgggactcggcccctctgaaggtgctgggggttggggacggcccaggcagtggcgtaggcgtcctaggaaggcgggagcagaggcagaaatgtcgctgcaagaccgtagtcagggtccttgaccacaggggtcacttgtgaccaaccacatggtctgttgttcctcctgccccctggttcagcccaggaaacactggtgctcaggtttggagccagagatttgcactgaaagggcgggattgagtcgccagttgtcagtttcctcagcagtatttgcggaggttttcacaggaggccgttgcttcgtaaatattatacatgtattcttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacgaccttaagcttctacgggaattccatctccatatctgccctgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaattagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttgggggtaggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagc

SEQ ID NO: 168728 - DNA, 2196 bp, Homo sapiens; identical to SEQ ID NO: 168717
  Payload ID: 13224
  Gene Symbol: PRAME
  Gene Name: preferentially expressed antigen in melanoma
  Uniprot ID: P78395
  ENST ID: ENST00000617728
  CDS Start-End: 301-1830

SEQ ID NO: 168729 - DNA, 891 bp, Homo sapiens; identical to SEQ ID NO: 168724
  Payload ID: 13224
  Gene Symbol: PRAME
  Gene Name: preferentially expressed antigen in melanoma
  ENST ID: ENST00000630573
  CDS Start-End: 287-891

SEQ ID NO: 168730 - DNA, 567 bp, Homo sapiens; identical to SEQ ID NO: 168720
  Payload ID: 13224
  Gene Symbol: PRAME
  Gene Name: preferentially expressed antigen in melanoma
  ENST ID: ENST00000630407
  CDS Start-End: 309-567

SEQ ID NO: 168731 - DNA, 2057 bp, Homo sapiens; identical to SEQ ID NO: 168721
  Payload ID: 13224
  Gene Symbol: PRAME
  Gene Name: preferentially expressed antigen in melanoma
  Uniprot ID: P78395
  ENST ID: ENST00000628830
  CDS Start-End: 228-1757

SEQ ID NO: 168732 - DNA, 2179 bp, Homo sapiens; identical to SEQ ID NO: 168719
  Payload ID: 13224
  Gene Symbol: PRAME
  Gene Name: preferentially expressed antigen in melanoma
  Uniprot ID: P78395
  ENST ID: ENST00000626503
  CDS Start-End: 287-1816

SEQ ID NO: 168733 - DNA, 705 bp, Homo sapiens; identical to SEQ ID NO: 168725
  Payload ID: 13224
  Gene Symbol: PRAME
  Gene Name: preferentially expressed antigen in melanoma
  ENST ID: ENST00000627660
  CDS Start-End: 248-705

SEQ ID NO: 168734 - DNA, 566 bp, Homo sapiens; identical to SEQ ID NO: 168723
  Payload ID: 13224
  Gene Symbol: PRAME
  Gene Name: preferentially expressed antigen in melanoma
  ENST ID: ENST00000631267
  CDS Start-End: 119-566

SEQ ID NO: 168735 - DNA, 727 bp, Homo sapiens
  Payload ID: 13224
  Gene Symbol: PRAME
  Gene Name: preferentially expressed antigen in melanoma
  ENST ID: ENST00000626772
  CDS Start-End: 384-727
gtacagctcccccgcagccagaagccgggcctgcagcgcctcagcaccgctccgggacaccccacccgcttcccaggcgtgacctgtcaacagcaacttcgcggtgtggtgaactctctgaggaaaaaccccaggaaacactggtgctcaggtttggagccagagatttgcactgaaagggcgggattgagtcgccagttgtcagtttcctcagcagtatttgcggaggttttcacaggaggccgttgcttcgtaaatattatacatgtattcttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccag

SEQ ID NO: 168736 - DNA, 1352 bp, Homo sapiens
  Payload ID: 13225
  Gene Symbol: PFDN1
  Gene Name: prefoldin subunit 1
  Uniprot ID: O60925
  ENST ID: ENST00000261813
  CDS Start-End: 49-417
cctatttcagtccaactcccactgcgcaggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaattactacatttgaccacgatctgtgctc

SEQ ID NO: 168737 - DNA, 1091 bp, Homo sapiens
  Payload ID: 13225
  Gene Symbol: PFDN1
  Gene Name: prefoldin subunit 1
  ENST ID: ENST00000510217
  CDS Start-End: 41-148
agtccaactcccactgcgcaggcgcttacagtgcaccaagatggccgcccccgtggatctagagctgaagaaggtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattat

SEQ ID NO: 168738 - DNA, 395 bp, Homo sapiens
  Payload ID: 13225
  Gene Symbol: PFDN1
  Gene Name: prefoldin subunit 1
  ENST ID: ENST00000524074
  CDS Start-End: 11-364
gtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaagtaacagagcccttcctttcttgggggatgggccttgccctcttctcttttcccttcctgtacctttgactaacgctcagcttccgggcctgcatgcagt

SEQ ID NO: 168739 - DNA, 677 bp, Homo sapiens
  Payload ID: 13226
  Gene Symbol: PFDN2
  Gene Name: prefoldin subunit 2
  Uniprot ID: Q9UHV9
  ENST ID: ENST00000368010
  CDS Start-End: 86-550
agcgagtgggcggtaactcgcaggccggacgtgacgcaaggcgggggctgagctgcgccggccggaaacccagcaggcggcgaagatggcggagaacagcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatctta

SEQ ID NO: 168740 - DNA, 1462 bp, Homo sapiens
  Payload ID: 13227
  Gene Symbol: PFDN4
  Gene Name: prefoldin subunit 4
  Uniprot ID: Q9NQP4
  ENST ID: ENST00000371419
  CDS Start-End: 255-659
acacccccgtgtttatgtcggtccacgggggttgcctgtccctttaattggcatgtaccaagtccttccaggtcacatttcctccctacgtcccagccgtttggactcactggccaaaagtccaagaggacggaatgtggagacagtgttgtatttttgcggggagttctaggccgaccgggagcgagagaacgctcgggggcgaagcgcgccattgcggccctccccgccgcctgcggtagtccagtcccaagatggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgatgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttccca

SEQ ID NO: 168741 - DNA, 579 bp, Homo sapiens
  Payload ID: 13227
  Gene Symbol: PFDN4
  Gene Name: prefoldin subunit 4
  ENST ID: ENST00000441080
  CDS Start-End: 7-417
cccaagatggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaaggaacacatgaatacacacagtagatgagaaggagccaggaaagaagatgatggaaaagtcaacggacaagagtcacccatggtaagatgtgcttacttcctcttcgccttctgccatgattgtaagtttcctgaggcctccaggtcatgcttcctgttaagcctgcagaact

SEQ ID NO: 168742 - DNA, 564 bp, Homo sapiens
  Payload ID: 13228
  Gene Symbol: PFDN5
  Gene Name: prefoldin subunit 5
  Uniprot ID: Q99471
  ENST ID: ENST00000243040
  CDS Start-End: 27-227
ctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 168743 - DNA, 478 bp, Homo sapiens
  Payload ID: 13228
  Gene Symbol: PFDN5
  Gene Name: prefoldin subunit 5
  Uniprot ID: Q99471
  ENST ID: ENST00000351500
  CDS Start-End: 44-373
gctcgccgagagacttcctcttcgttaagtcggccttcccaacatggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 168744 - DNA, 586 bp, Homo sapiens
  Payload ID: 13228
  Gene Symbol: PFDN5
  Gene Name: prefoldin subunit 5
  Uniprot ID: Q99471
  ENST ID: ENST00000334478
  CDS Start-End: 17-481
agtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 168745 - DNA, 847 bp, Homo sapiens
  Payload ID: 13228
  Gene Symbol: PFDN5
  Gene Name: prefoldin subunit 5
  Uniprot ID: Q99471
  ENST ID: ENST00000551018
  CDS Start-End: 278-742
atatcgtggttgtgtcgtgagaactttaagattttgcagttccttgtaggcaggagtcctgtttgctgctactttacaatactaggcttaagacattttatgaaatgaactcacacaacagtctctgagaggctcaagcccctccttcccttccgggacggaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 168746 - DNA, 559 bp, Homo sapiens
  Payload ID: 13228
  Gene Symbol: PFDN5
  Gene Name: prefoldin subunit 5
  ENST ID: ENST00000547130
  CDS Start-End: 27-116
ctcttcgttaagtcggccttcccaacatggcgcagtctattaacatcacggagctgaatctgccgcagctagaaatgctcaagaaccagctggaccaggctggagcgcaatggtgagatcttggcttactgcaacctccgcctcccgagttcaagagattcttctgcctcagtctcccgagtagctgggactttagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 168747 - DNA, 595 bp, Homo sapiens
  Payload ID: 13228
  Gene Symbol: PFDN5
  Gene Name: prefoldin subunit 5
  ENST ID: ENST00000550880
  CDS Start-End: 44-157
gctcgccgagagacttcctcttcgttaagtcggccttcccaacatggcgcagtctattaacatcacggagctgaatctgccgcagctagaaatgctcaagaaccagctggaccagacggaatttcgctctgtcgcccaggctggagcgcaatggtgagatcttggcttactgcaacctccgcctcccgagttcaagagattcttctgcctcagtctcccgagtagctgggactttagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctggg

SEQ ID NO: 168748 - DNA, 571 bp, Homo sapiens
  Payload ID: 13228
  Gene Symbol: PFDN5
  Gene Name: prefoldin subunit 5
  ENST ID: ENST00000552742
  CDS Start-End: 13-102
ggccttcccaacatggcgcagtctattaacatcacggagctgaatctgccgcagctagaaatgctcaagaaccagctggaccaggctggagcgcaatggtgagatcttggcttactgcaacctccgcctcccgagttcaagagattcttctgcctcagtctcccgagtagctgggactttagatgtatgtccctgggaagctgcatgatgtggaacacgtgctcatcgatgtgggaactgggtactatgtagagaagccccttattcacctctgatcttgtagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 168749 - DNA, 392 bp, Homo sapiens
  Payload ID: 13228
  Gene Symbol: PFDN5
  Gene Name: prefoldin subunit 5
  ENST ID: ENST00000550846
  CDS Start-End: 33-287
gacttcctcttcgttaagtcggccttcccaacatggcgcagtctattaacatcacggagctgaatctgccgcagctagaaatgctcaagaaccagctggaccagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 168750 - DNA, 559 bp, Homo sapiens
  Payload ID: 13228
  Gene Symbol: PFDN5
  Gene Name: prefoldin subunit 5
  ENST ID: ENST00000549759
  CDS Start-End: 1-457
taacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggacggaatttcgctctgtcgcccaggctggagcgcaatgatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 168751 - DNA, 231 bp, Homo sapiens
  Payload ID: 13228
  Gene Symbol: PFDN5
  Gene Name: prefoldin subunit 5
  ENST ID: ENST00000628881
  CDS Start-End: 118-231
gaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccagacggaatttcgctctgtcgcccaggctggagcgcaatggtga

SEQ ID NO: 168752 - DNA, 740 bp, Homo sapiens
  Payload ID: 13229
  Gene Symbol: PFDN6
  Gene Name: prefoldin subunit 6
  Uniprot ID: O15212
  ENST ID: ENST00000374606
  CDS Start-End: 263-652
gggtttattactactgaaggaagaacgtgagtaggttaggatttcggttgagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgg

SEQ ID NO: 168753 - DNA, 598 bp, Homo sapiens
  Payload ID: 13229
  Gene Symbol: PFDN6
  Gene Name: prefoldin subunit 6
  Uniprot ID: O15212
  ENST ID: ENST00000374607
  CDS Start-End: 120-509
gtttattactactgaaggaagaacgtgagtaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctggc

SEQ ID NO: 168754 - DNA, 521 bp, Homo sapiens
  Payload ID: 13229
  Gene Symbol: PFDN6
  Gene Name: prefoldin subunit 6
  Uniprot ID: O15212
  ENST ID: ENST00000374610
  CDS Start-End: 115-504
gtttattactactgaaggaagaacgtgagtagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggag

SEQ ID NO: 168755 - DNA, 521 bp, Homo sapiens; identical to SEQ ID NO: 168754
  Payload ID: 13229
  Gene Symbol: PFDN6
  Gene Name: prefoldin subunit 6
  Uniprot ID: O15212
  ENST ID: ENST00000383207
  CDS Start-End: 115-504

SEQ ID NO: 168756 - DNA, 884 bp, Homo sapiens
  Payload ID: 13229
  Gene Symbol: PFDN6
  Gene Name: prefoldin subunit 6
  Uniprot ID: O15212
  ENST ID: ENST00000395131
  CDS Start-End: 407-796
atcttgagtgagggcacgctctccttagaggggcggaacagtttttggcaccttatcgcgagcggcagcttatgcaagagtgatttaaaaaagaaaggcaggtccggagccaggggctaagtagcggtgcggtttctttttctggattagtttccccatcttgcctaaaaatgtcctagtctagtctttttagcagaactccactccctaaacatgtcagaactacacttcccatcaagggtcagaaagaaacttccggcacagtcttttcccagcattccttgtttacttccgggtttattactactgaaggaagaacgccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgg

SEQ ID NO: 168757 - DNA, 740 bp, Homo sapiens; identical to SEQ ID NO: 168752
  Payload ID: 13229
  Gene Symbol: PFDN6
  Gene Name: prefoldin subunit 6
  Uniprot ID: O15212
  ENST ID: ENST00000399383
  CDS Start-End: 263-652

SEQ ID NO: 168758 - DNA, 884 bp, Homo sapiens
  Payload ID: 13229
  Gene Symbol: PFDN6
  Gene Name: prefoldin subunit 6
  Uniprot ID: O15212
  ENST ID: ENST00000399385
  CDS Start-End: 407-796
atcttgagtgagggcacgctctccttagaggggcggaacagtttttggcaccttatcgcgagcggcagcttatgcaagagtgacttaaaaaagaaaggcaggtccggggccaggggctaagtagcggtgcggtttctttttctggattagtttccccatcttgcctaaaaatgtcctagtctagtctttttagcagaactccactccctaaacatgtcagaactacacttcccatcaagggtcagaaagaaacttccggcacagtcttttcccagcattccttgtttacttccgggtttattactactgaaggaagaacgccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgg

SEQ ID NO: 168759 - DNA, 740 bp, Homo sapiens; identical to SEQ ID NO: 168752
  Payload ID: 13229
  Gene Symbol: PFDN6
  Gene Name: prefoldin subunit 6
  Uniprot ID: O15212
  ENST ID: ENST00000425878
  CDS Start-End: 263-652

SEQ ID NO: 168760 - DNA, 884 bp, Homo sapiens; identical to SEQ ID NO: 168758
  Payload ID: 13229
  Gene Symbol: PFDN6
  Gene Name: prefoldin subunit 6
  Uniprot ID: O15212
  ENST ID: ENST00000445559
  CDS Start-End: 407-796

SEQ ID NO: 168761 - DNA, 740 bp, Homo sapiens; identical to SEQ ID NO: 168752
  Payload ID: 13229
  Gene Symbol: PFDN6
  Gene Name: prefoldin subunit 6
  Uniprot ID: O15212
  ENST ID: ENST00000432391
  CDS Start-End: 263-652

SEQ ID NO: 168762 - DNA, 884 bp, Homo sapiens; identical to SEQ ID NO: 168758
  Payload ID: 13229
  Gene Symbol: PFDN6
  Gene Name: prefoldin subunit 6
  Uniprot ID: O15212
  ENST ID: ENST00000412289
  CDS Start-End: 407-796

SEQ ID NO: 168763 - DNA, 884 bp, Homo sapiens
  Payload ID: 13229
  Gene Symbol: PFDN6
  Gene Name: prefoldin subunit 6
  Uniprot ID: O15212
  ENST ID: ENST00000431830
  CDS Start-End: 407-796
atcttgagtgagggcacgctctccttagaggggcggaacagtttttggcaccttatcgcgagcggcagcttatgcaagagtgacttaaaaaagaaaggcaggtccggagccaggggctaagtagcggtgcggtttctttttctggattagtttccccatcttgcctaaaaatgtcctagtctagtctttttagcagaactccactccctaaacatgtcagaactacacttcccatcaagggtcagaaagaaacttccggcacagtcttttcccagcattccttgtttacttccgggtttattactactgaaggaagaacgccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaattaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctgg

SEQ ID NO: 168764 - DNA, 521 bp, Homo sapiens; identical to SEQ ID NO: 168754
  Payload ID: 13229
  Gene Symbol: PFDN6
  Gene Name: prefoldin subunit 6
  Uniprot ID: O15212
  ENST ID: ENST00000448594
  CDS Start-End: 115-504

SEQ ID NO: 168765 - DNA, 521 bp, Homo sapiens; identical to SEQ ID NO: 168754
  Payload ID: 13229
  Gene Symbol: PFDN6
  Gene Name: prefoldin subunit 6
  Uniprot ID: O15212
  ENST ID: ENST00000442285
  CDS Start-End: 115-504

SEQ ID NO: 168766 - DNA, 740 bp, Homo sapiens; identical to SEQ ID NO: 168752
  Payload ID: 13229
  Gene Symbol: PFDN6
  Gene Name: prefoldin subunit 6
  Uniprot ID: O15212
  ENST ID: ENST00000452658
  CDS Start-End: 263-652

SEQ ID NO: 168767 - DNA, 521 bp, Homo sapiens; identical to SEQ ID NO: 168754
  Payload ID: 13229
  Gene Symbol: PFDN6
  Gene Name: prefoldin subunit 6
  Uniprot ID: O15212
  ENST ID: ENST00000451970
  CDS Start-End: 115-504

SEQ ID NO: 168768 - DNA, 1915 bp, Homo sapiens
  Payload ID: 13229
  Gene Symbol: PFDN6
  Gene Name: prefoldin subunit 6
  ENST ID: ENST00000474406
  CDS Start-End: 83-394
atcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaatatttctgaggacaatcccagacccaggagatgttccagactcatttttctgatattcagagagggcaagagtcttggcctatgtcacacagcagagtccaggactccagaactccaacctagcactctggccagaaagtcagccagaggaaggaaaactgggaatgaagagtcagaggtgagaagctaaagtcatgatctcaccaagggatcaagaggtcgatattggcggcttgtgacggtaaacacggcaccatcctcctcctcatcccagacggacacaggggcctggaggagcaaggaaggggaagtcagacagttccacaccaccccccattgccctcagccttcaccccaggccctgctcctccctctgtacccctcacctgtggtggcagggcatagtaccagcgagtgcgaggaagggttgggggagctggtgaccccaggtctcccccactggggcccagacagccccaccccagccgcctcagggccccggtggagtcgaaggggctgcagtggaggcgtggatggagtacaggaattctgatcctggagacccccaaagccccttctccccagagctgaacccacacacgacagagaagcagggtacaaagggcaggagagggaagcgagaggcagcaagccagaggcagcgactaggggtagctgaaacctcagtccaggcactgccgcatgccccgcccctcccggccaaggactataccagcccagagaattagtctttttcaggacccctttcaccctggtccctcgggtagcgcctccactatctcagccctaagggacccccgaaggtagcagctccaatcccagtacaggaaggaaaaggggaagtgggatgatagggggttgggggcggtagactcagagagtcacgtggccccagcccctcccccgaccgatcccgaaaaaccagccctgccagtcaacctgccctcacctaggatctggacctaggagtttagggcctcggggccccaaatccaaattctggcccctcctgaggcccgaaatcctgctcctggccaccaccattaatccctaatgaaaacagatgaccactctctacccaccctaggatctttcctccaggtcccagaaccgtggcttcccggcctctacccaggaccggggcggggcgggggggcggggggaagggggagagagggaaggaggggtcacgaaatctgagggttccctccccaatcccagagtcagaggagctggttactgtggaaacaaacccctccccgccaaacaaaaacaaggagggagacagggaccaagacacgactgctcagagaggtaggcacactcaggcaggcagaggtggagggccaaagacccgcagggacaggacagccagccagaagttccaggcaggaacagggcaggttcctgcgggcaggtcctgagtcacactgacagagaaccacggagacgccaggactccccgcagcagagaaacgggccgacacccagggaggcgcgagaataactgaggcaaggaggaggagatgtagggacccagagacaagagaaaa

SEQ ID NO: 168769 - DNA, 1917 bp, Homo sapiens
  Payload ID: 13229
  Gene Symbol: PFDN6
  Gene Name: prefoldin subunit 6
  ENST ID: ENST00000482292
  CDS Start-End: 85-396
agatcagaaaagggagctcaggtaccttccagagagtgagacccagcgcccttgtctcgcacccagtaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctgggggaggctcgggccacagtagggaagaggctggactatatcacagctgaaatatttctgaggacaatcccagacccaggagatgttccagactcatttttctgatattcagagagggcaagagtcttggcctatgtcacacagcagagtccaggactccagaactccaacctagcactctggccagaaagtcagccagaggaaggaaaactgggaatgaagagtcagaggtgagaagctaaagtcatgatctcaccaagggatcaagaggtcgatattggcggcttgtgacggtaaacacggcaccatcctcctcctcatcccagacggacacaggggcctggaggagcaaggaaggggaagtcagacagttccacaccaccccccattgccctcagccttcaccccaggccctgctcctccctctgtacccctcacctgtggtggcagggcatagtaccagcgagtgcgaggaagggttgggggagctggtgaccccaggtctcccccactggggcccagacagccccaccccagccgcctcagggccccggtggagtcgaaggggctgcagtggaggcgtggatggagtacaggaattctgatcctggagacccccaaagccccttctccccagagctgaacccacacacgacagagaagcagggtacaaagggcaggagagggaagcgagaggcagcaagccagaggcagcgactaggggtagctgaaacctcagtccaggcactgccgcatgccccgcccctcccggccaaggactataccagcccagagaattagtctttttcaggacccctttcaccctggtccctcgggtagcgcctccactatctcagccctaagggacccccgaaggtagcagctccaatcccagtacaggaaggaaaaggggaagtgggatgatagggggttgggggcggtagactcagagagtcacgtggccccagcccctcccccgaccgatcccgaaaaaccagccctgccagtcaacctgccctcacctaggatctggacctaggagtttagggcctcggggccccaaatccaaattctggcccctcctgaggcccgaaatcctgctcctggccaccaccattaatccctaatgaaaacagatgaccactctctacccaccctaggatctttcctccaggtcccagaaccgtggcttcccggcctctacccaggaccggggcggggcgggggggcggggggaagggggagagagggaaggaggggtcacgaaatctgagggttccctccccaatcccagagtcagaggagctggttactgtggaaacaaacccctccccgccaaacaaaaacaaggagggagacagggaccaagacacgactgctcagagaggtaggcacactcaggcaggcagaggtggagggccaaagacccgcagggacaggacagccagccagaagttccaggcaggaacagggcaggttcctgcgggcaggtcctgagtcacactgacagagaaccacggagacgccaggactccccgcagcagagaaacgggccgacacccagggaggcgcgagaataactgaggcaaggaggaggagatgtagggacccagagacaagagaaaa

SEQ ID NO: 168770 - DNA, 1915 bp, Homo sapiens; identical to SEQ ID NO: 168768
  Payload ID: 13229
  Gene Symbol: PFDN6
  Gene Name: prefoldin subunit 6
  ENST ID: ENST00000468094
  CDS Start-End: 83-394

SEQ ID NO: 168771 - DNA, 1915 bp, Homo sapiens; identical to SEQ ID NO: 168768
  Payload ID: 13229
  Gene Symbol: PFDN6
  Gene Name: prefoldin subunit 6
  ENST ID: ENST00000463584
  CDS Start-End: 83-394

SEQ ID NO: 168772 - DNA, 1915 bp, Homo sapiens; identical to SEQ ID NO: 168768
  Payload ID: 13229
  Gene Symbol: PFDN6
  Gene Name: prefoldin subunit 6
  ENST ID: ENST00000491095
  CDS Start-End: 83-394

SEQ ID NO: 168773 - DNA, 598 bp, Homo sapiens; identical to SEQ ID NO: 168753
  Payload ID: 13229
  Gene Symbol: PFDN6
  Gene Name: prefoldin subunit 6
  Uniprot ID: O15212
  ENST ID: ENST00000548040
  CDS Start-End: 120-509

SEQ ID NO: 168774 - DNA, 598 bp, Homo sapiens; identical to SEQ ID NO: 168753
  Payload ID: 13229
  Gene Symbol: PFDN6
  Gene Name: prefoldin subunit 6
  Uniprot ID: O15212
  ENST ID: ENST00000552711
  CDS Start-End: 120-509

SEQ ID NO: 168775 - DNA, 598 bp, Homo sapiens; identical to SEQ ID NO: 168753
  Payload ID: 13229
  Gene Symbol: PFDN6
  Gene Name: prefoldin subunit 6
  Uniprot ID: O15212
  ENST ID: ENST00000547952
  CDS Start-End: 120-509

SEQ ID NO: 168776 - DNA, 598 bp, Homo sapiens; identical to SEQ ID NO: 168753
  Payload ID: 13229
  Gene Symbol: PFDN6
  Gene Name: prefoldin subunit 6
  Uniprot ID: O15212
  ENST ID: ENST00000547641
  CDS Start-End: 120-509

SEQ ID NO: 168777 - DNA, 2276 bp, Homo sapiens
  Payload ID: 13230
  Gene Symbol: PSG1
  Gene Name: pregnancy specific beta-1-glycoprotein 1
  Uniprot ID: P11464
  ENST ID: ENST00000244296
  CDS Start-End: 139-1419
gagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctggtaagtggatcccagcatcgttggcaatagggttttaggtggagtctatctggcattcagagaagagtcaggaaaacaattgtattcccagcctgtgtcccatgggcacaagcaaatcccaaattctcctcctgaaccctccaaatttgtctaagaacttcgaaaactttaacaaacaggctgatatcttcataatattcccagcctagaccaagcaggaagaacattgatttcattgaaataattgataataatgaagataatgtttttatgatttttatttgaaaatttgctgattctttaaatggtttgttttctacattgatggaatttttctcttttaatctatctacagcttatagcagttcaataaactatacttctgggaaccgtaattgaaacatttacttttgctttctacctgactgccccagaattgggcaactattcatgagaattgatatgtttatggtaatacacatatttgcacaagtacagtaacaatctgctttctttgtaacatgacacatttgaaatcattggttatattaccaatgctttgattcggatgttatattaaaaacatagatagaatgaaccaatatgaactgcaggcaaagtctgaagtcagccttggtttggcttcctattctcaagaggtttgtgaagatttaatctcagattccttataaaaacttagagaaaagaaaattttagaagacagcctacatggtccattgctactcttgctgcacttatgtaaacaatcagaccacatttgaagaaactccacctattttgcaaacaaacttattctactgaaattatcattggtaaaagtagagatgcccatagagggaaaaattatgtggaaaataaaaactgtagtatacct

SEQ ID NO: 168778 - DNA, 1882 bp, Homo sapiens
  Payload ID: 13230
  Gene Symbol: PSG1
  Gene Name: pregnancy specific beta-1-glycoprotein 1
  Uniprot ID: P11464
  ENST ID: ENST00000312439
  CDS Start-End: 87-1373
ggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgcttatagcagttcaataaactatacttctgggaaccgtaattgaaacatttacttttgctttctacctgactgccccagaattgggcaactattcatgagaattgatatgtttatggtaatacacatatttgcacaagtacagtaacaatctgctttctttgtaacatgacacatttgaaatcattggttatattaccaatgctttgattcggatgttatattaaaaacatagatagaatgaaccaatatgaactgcaggcaaagtctgaagtcagccttggtttggcttcctattctcaagaggtttgtgaagatttaatctcagattccttataaaaacttagagaaaagaaaattttagaagacagcctacatggtccattgctactcttgctgcacttatgtaaacaatcagaccacatttgaagaaactccacctattttgcaaacaaacttattctactgaaattatcattggtaaaagtagagatgcccatagagggaaaaattatgtggaaaataaaaactgtagtatacctgttatgagactgc

SEQ ID NO: 168779 - DNA, 1722 bp, Homo sapiens
  Payload ID: 13230
  Gene Symbol: PSG1
  Gene Name: pregnancy specific beta-1-glycoprotein 1
  ENST ID: ENST00000403380
  CDS Start-End: 91-1071
ggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaa

SEQ ID NO: 168780 - DNA, 2047 bp, Homo sapiens
  Payload ID: 13230
  Gene Symbol: PSG1
  Gene Name: pregnancy specific beta-1-glycoprotein 1
  Uniprot ID: P11464
  ENST ID: ENST00000436291
  CDS Start-End: 118-1377
cctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaa

SEQ ID NO: 168781 - DNA, 757 bp, Homo sapiens
  Payload ID: 13230
  Gene Symbol: PSG1
  Gene Name: pregnancy specific beta-1-glycoprotein 1
  ENST ID: ENST00000595930
  CDS Start-End: 296-757
gtgtgtgtgtgtgtgtgtttgtatgtgtgtgtgtgtctgtgttgtcaaggctgaggactgaagagaccttctcaggacccagggccccatgttttcacaccaatacataggtctcaatattgactgatgttctctccacctcctagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgcc

SEQ ID NO: 168782 - DNA, 725 bp, Homo sapiens
  Payload ID: 13230
  Gene Symbol: PSG1
  Gene Name: pregnancy specific beta-1-glycoprotein 1
  ENST ID: ENST00000597058
  CDS Start-End: 1-725
atcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctccatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctg

SEQ ID NO: 168783 - DNA, 1692 bp, Homo sapiens
  Payload ID: 13230
  Gene Symbol: PSG1
  Gene Name: pregnancy specific beta-1-glycoprotein 1
  ENST ID: ENST00000595124
  CDS Start-End: 130-1104
aattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgct

SEQ ID NO: 168784 - DNA, 1903 bp, Homo sapiens
  Payload ID: 13230
  Gene Symbol: PSG1
  Gene Name: pregnancy specific beta-1-glycoprotein 1
  Uniprot ID: P11464
  ENST ID: ENST00000595356
  CDS Start-End: 67-1320
gtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacct

SEQ ID NO: 168785 - DNA, 990 bp, Homo sapiens
  Payload ID: 13231
  Gene Symbol: PSG11
  Gene Name: pregnancy specific beta-1-glycoprotein 11
  Uniprot ID: Q9UQ72
  ENST ID: ENST00000306322
  CDS Start-End: 98-739
agaaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagtggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcagattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcagaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttgatgaacaggctgataccttcatgaaattcaagacaaagaagaaaagaa

SEQ ID NO: 168786 - DNA, 1575 bp, Homo sapiens
  Payload ID: 13231
  Gene Symbol: PSG11
  Gene Name: pregnancy specific beta-1-glycoprotein 11
  Uniprot ID: Q9UQ72
  ENST ID: ENST00000320078
  CDS Start-End: 141-1148
tgagcttgagaagtgctccttccaccgggaagagtctcagcgcagaaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatatgtagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcagattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcaggagatttatggaaaagactatgaaaaggactcttgaatacaagttcctgataacttcaagatcataccactggactaagaactttcaaaattttgatgaacaggctgataccttcatgaaattcaagacaaagaagaaaagaactccatttcattggactaaataacaaaaggataatgttttcataattttttattggaaaatgtgctgattttttgaatgttttatcctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagttta

SEQ ID NO: 168787 - DNA, 1163 bp, Homo sapiens
  Payload ID: 13231
  Gene Symbol: PSG11
  Gene Name: pregnancy specific beta-1-glycoprotein 11
  Uniprot ID: Q9UQ72
  ENST ID: ENST00000403486
  CDS Start-End: 95-736
aggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagtggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcagattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcaggagatttatggaaaagactatgaaaaggactcttgaatacaagttcctgataacttcaagatcataccactggactaagaactttcaaaattttgatgaacaggctgataccttcatgaaattcaagacaaagaagaaaagaactccatttcattggactaaataacaaaaggataatgttttcataattttttattggaaaatgtgctgattttttgaatgttttatcctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagttta

SEQ ID NO: 168788 - DNA, 1036 bp, Homo sapiens
  Payload ID: 13231
  Gene Symbol: PSG11
  Gene Name: pregnancy specific beta-1-glycoprotein 11
  ENST ID: ENST00000598133
  CDS Start-End: 77-1036
gctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatatgtagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacccaaagctgcccatgccctacatcaccatcaacaacttaaaccccagggagaataaggatgtcttaaccttcacctgtgaacctaagagtgagaactatgcctacatttggtggctaaattgtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgactcagtcaccctgaatgtcctctatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcagattactccaaagcataatgggctctatgcttgctctgctcgtaactcagccactggcgaggaaagctccacatccttgacaatcagagtc

SEQ ID NO: 168789 - DNA, 1942 bp, Homo sapiens
  Payload ID: 13231
  Gene Symbol: PSG11
  Gene Name: pregnancy specific beta-1-glycoprotein 11
  ENST ID: ENST00000593983
  CDS Start-End: 92-472
ccatgcggacccctggggaagaggattccaaacagaaaaatgccaagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatatgtagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttataccgtcattccttggactctgctctatctttagaggtcactggctcaagtcagtcactatgagacacctgggaaaactgccccaccttgtggctgcactgcctgatgactgaactgacctccaggcttgactctggtctcccctgtgttatttctgctgaagtacccagtcccaggccaggctttccagtacccaaagggtttaaggacaatgggaagttccatcatccatctctaggatgtccttggcaagggaagctgcagagaaaacataccttggggggaaaagtaagactgaaactaagaagattccagcactgcatgctccaagtcaggaccaaaagtggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctcccaaagctgcccatgccctacatcaccatcaacaacttaaaccccagggagaataaggatgtcttaaccttcacctgtgaacctaagagtgagaactatgcctacatttggtggctaaattgtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgactcagtcaccctgaatgtcctctattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcagaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttgatgaacaggctgataccttcatgaaattcaagacaaagaagaaaagaactccatttcattggactaaataacaaaaggataatgttttcataattttttattggaaaatgtgctgattttttgaatgttttatcctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtt

SEQ ID NO: 168790 - DNA, 795 bp, Homo sapiens
  Payload ID: 13232
  Gene Symbol: PSG2
  Gene Name: pregnancy specific beta-1-glycoprotein 2
  ENST ID: ENST00000329509
  CDS Start-End: 1-353
tacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcagagtgaaatcccttcaaccatctgcactgcagacttaaccacacccttcatcacaagcaacatgtgacctcgtggagaacaaagactttaggattaacatgtgaacctgagactcagaacacaacctatgtgtggttgagatcttttcctgatgatcagttcatgtgttcaaaaaacatacagaaatgaagaaggcaaggtccctaccccaggagacataaagcctaagacaggaaatgagacctgaaaataatcatgataccaaaatagaaaaaattgaatgccacaagaaatcagagaaatctgatgggaaatagagctacacattggaatcactggaaaacatttctaaaagtggatgctcaagccccacccattagttccagttcaaaggtctggagag

SEQ ID NO: 168791 - DNA, 1538 bp, Homo sapiens
  Payload ID: 13232
  Gene Symbol: PSG2
  Gene Name: pregnancy specific beta-1-glycoprotein 2
  Uniprot ID: P11465
  ENST ID: ENST00000406487
  CDS Start-End: 100-1107
gcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcttgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactggcgaggaaagctccacatcgttgacagtcaaagtctctgcttctacaagaataggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggctgataccttcatgaaattcaagacaaagaagaaaaatactcaatgttattggactaaataatcaaaaggataatgatttcataattttctatttgaaaatgtgctgattcttggaatgtttcattctccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagtt

SEQ ID NO: 168792 - DNA, 1961 bp, Homo sapiens
  Payload ID: 13233
  Gene Symbol: PSG3
  Gene Name: pregnancy specific beta-1-glycoprotein 3
  Uniprot ID: Q16557
  ENST ID: ENST00000327495
  CDS Start-End: 186-1472
tgagagaggaggggacagagaggtgtcctgggcctgaccccgcccatgaacctgagaagtgctcctgccccgggaagaggctcagcgcagaaggaggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcattacttttaaacttctggaacttgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttca

SEQ ID NO: 168793 - DNA, 1724 bp, Homo sapiens
  Payload ID: 13233
  Gene Symbol: PSG3
  Gene Name: pregnancy specific beta-1-glycoprotein 3
  ENST ID: ENST00000595140
  CDS Start-End: 94-1521
ggaggaaggacagcacagctgagagccatgctcaggaagtttctggatcctaggctcagctccacagaggagaacacgcaggcagcagagaccatggggcccctctcagcccctccctgcacacagcgcatcacctggaaggggctcctgctcacagcattacttttaaacttctggaacttgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaa

SEQ ID NO: 168794 - DNA, 1947 bp, Homo sapiens
  Payload ID: 13233
  Gene Symbol: PSG3
  Gene Name: pregnancy specific beta-1-glycoprotein 3
  ENST ID: ENST00000594378
  CDS Start-End: 202-477
gggggccgtgcggacccctggggaagaggattccaaacagaaaaatgccaagcattacttttaaacttctggaacttgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttataccgtcattccttggactctgctctatctttagaggtcactggctcaagtcagccactatgagacacctgggaaaactgccccaccttgtggctccactgcctgatgactgaactgaactccggacttgactctgttctcccctgtgttatttctgctgaagtacccagtcccaggtcaggctttccagtatccaaagggtttaaagacaattggaagttccatcacccatctctaggatgtccttggcaagggaagctgcagagaaaacatacctcgggcggcaaagtaagactgaaactaagaagattccagcactgcatgctccaagtgaggaccacaagtggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaagactctgacaaggactcttgaatacaagttcctgataacttcaagatcataccactggactaagaactttcaaaattttaatgaacaggctgatacttcatgaaattcaagacaaagaaaaaaacccaattttattggactaaatagtcaaaacaatgttttcataattttctatttgaaaatgtgctgattctttgaatgttttattctccagatttatgcactttttttcttcagcaattggtaaagtatacttttgtaaacaaaaattgaaacatttgcttttgctccctaagtgccccagaattgggaaactattcaggagtattcatatgtttatggtaataaagttatctgcacaagttcagtaa

SEQ ID NO: 168795 - DNA, 1287 bp, Homo sapiens
  Payload ID: 13233
  Gene Symbol: PSG3
  Gene Name: pregnancy specific beta-1-glycoprotein 3
  Uniprot ID: Q16557
  ENST ID: ENST00000614582
  CDS Start-End: 1-1287
atggggcccctctcagcccctccctgcacacagcgcatcacctggaaggggctcctgctcacagcattacttttaaacttctggaacttgcctaccactgcccaagtcacgattgaagccgagccaaccaaagtttccaaggggaaggacgttcttctacttgtccacaatttgccccagaatcttgctggctacatctggtacaaagggcaaatgaaggacctctaccattacattacatcatacgtagtagatggtcaaataattatatatgggcctgcatacagtggacgagaaacagtatattccaatgcatccctgctgatccagaatgtcacccgggaggacgcaggatcctacaccttacacatcgtaaagcgaggtgatgggactagaggagaaactggacatttcaccttcaccttatacctggagactcccaagccctccatctccagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatag

SEQ ID NO: 168796 - DNA, 1629 bp, Homo sapiens
  Payload ID: 13234
  Gene Symbol: PSG4
  Gene Name: pregnancy specific beta-1-glycoprotein 4
  Uniprot ID: Q00888
  ENST ID: ENST00000244295
  CDS Start-End: 28-1008
gaggagaacacacaagcagcagagaccatggggcccctctcagcccctccctgcacacagcgcatcacctggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaaccgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgt

SEQ ID NO: 168797 - DNA, 2168 bp, Homo sapiens
  Payload ID: 13234
  Gene Symbol: PSG4
  Gene Name: pregnancy specific beta-1-glycoprotein 4
  Uniprot ID: Q00888
  ENST ID: ENST00000405312
  CDS Start-End: 239-1498
agggacctgaaacacagacaaaaggaaaaacaggagggacaaggaggcagaactgagagaggaggggacagagaggtgtcctgggcctgaccccgcccacgagcttgagaaatgctcctgccccgggaggaggctcagcacagaaggaggaaggacagcacagctgacagccgtactcaggaagcttctggatcctaggcttatctccacagaggagaacacacaagcagcagagaccatggggcccctctcagcccctccctgcacacagcgcatcacctggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaaccgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 168798 - DNA, 1887 bp, Homo sapiens
  Payload ID: 13234
  Gene Symbol: PSG4
  Gene Name: pregnancy specific beta-1-glycoprotein 4
  Uniprot ID: Q00888
  ENST ID: ENST00000433626
  CDS Start-End: 239-1219
agggacctgaaacacagacaaaaggaaaaacaggagggacaaggaggcagaactgagagaggaggggacagagaggtgtcctgggcctgaccccgcccacgagcttgagaaatgctcctgccccgggaggaggctcagcacagaaggaggaaggacagcacagctgacagccgtactcaggaagcttctggatcctaggcttatctccacagaggagaacacacaagcagcagagaccatggggcccctctcagcccctccctgcacacagcgcatcacctggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacccaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaaccgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgct

SEQ ID NO: 168799 - DNA, 996 bp, Homo sapiens
  Payload ID: 13234
  Gene Symbol: PSG4
  Gene Name: pregnancy specific beta-1-glycoprotein 4
  ENST ID: ENST00000451895
  CDS Start-End: 240-996
agcacagaaggaggaaggacagcacagctgacagccgtactcaggaagcttctggatcctaggcttatctccacagaggagaacacacaagcagcagagaccatggggcccctctcagcccctccctgcacacagcgcatcacctggaagggggtcctgctcacaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcc

SEQ ID NO: 168800 - DNA, 731 bp, Homo sapiens
  Payload ID: 13234
  Gene Symbol: PSG4
  Gene Name: pregnancy specific beta-1-glycoprotein 4
  ENST ID: ENST00000599746
  CDS Start-End: 1-731
catcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacccaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtct

SEQ ID NO: 168801 - DNA, 526 bp, Homo sapiens
  Payload ID: 13234
  Gene Symbol: PSG4
  Gene Name: pregnancy specific beta-1-glycoprotein 4
  ENST ID: ENST00000600572
  CDS Start-End: 292-526
agaaagggaagacccagggtctctgaaggaggtatcaggaaagaagtctaaggatgccctgatgtgagcaggacctgagggcagtgtggagggggccgtgcggacccctggggaagaggaatccaaaaagaaaaatgccaagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccct

SEQ ID NO: 168802 - DNA, 763 bp, Homo sapiens
  Payload ID: 13234
  Gene Symbol: PSG4
  Gene Name: pregnancy specific beta-1-glycoprotein 4
  ENST ID: ENST00000601041
  CDS Start-End: 98-256
agaaggaggaaggacagcacagctgacagccgtactcaggaagcttctggatcctaggcttatctccacagaggagaacacacaagcagcagagaccatggggcccctctcagcccctccctgcacacagcgcatcacctggaagggggtcctgctcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatg

SEQ ID NO: 168803 - DNA, 976 bp, Homo sapiens
  Payload ID: 13234
  Gene Symbol: PSG4
  Gene Name: pregnancy specific beta-1-glycoprotein 4
  ENST ID: ENST00000596907
  CDS Start-End: 100-976
acagaaggaggaaggacagcacagctgacagccgtactcaggaagcttctggatcctaggcttatctccacagaggagaacacacaagcagcagagaccatggggcccctctcagcccctccctgcacacagcgcatcacctggaagggggtcctgctcacagtggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctg

SEQ ID NO: 168804 - DNA, 1034 bp, Homo sapiens
  Payload ID: 13234
  Gene Symbol: PSG4
  Gene Name: pregnancy specific beta-1-glycoprotein 4
  ENST ID: ENST00000595949
  CDS Start-End: 77-199
gctgacagccgtactcaggaagcttctggatcctaggcttatctccacagaggagaacacacaagcagcagagaccatggggcccctctcagcccctccctgcacacagcgcatcacctggaagggggtcctgctcacaggtcattccttggactctgctctatctttagaggtcactggctcaagtcagtcaccatgagacacctgggaaaactgcgccaccttgtggctccactgcctgatgactgaactgacctccaggcttgactctggtctcccctgtgttatttatgctgaagtacccagtcccaggtcaggctttccagtacccaaagggtttaaggacaatgggaagttccatcatccatctctaggatgtccttggaaagggaagctgcagagaaaacatacctcggggggcaaagtaagactgaaactaagaagattccagcactgcatgctccaagtgaggaccacaagtggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtc

SEQ ID NO: 168805 - DNA, 828 bp, Homo sapiens
  Payload ID: 13234
  Gene Symbol: PSG4
  Gene Name: pregnancy specific beta-1-glycoprotein 4
  ENST ID: ENST00000597374
  CDS Start-End: 1-775
gtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtaagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgcctacatgg

SEQ ID NO: 168806 - DNA, 648 bp, Homo sapiens
  Payload ID: 13234
  Gene Symbol: PSG4
  Gene Name: pregnancy specific beta-1-glycoprotein 4
  ENST ID: ENST00000599371
  CDS Start-End: 1-289
ggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccgctcttattaatgactgccacaacagaaacactgagaaaaagaggcaaccatgaaaacgtggaaagttctgacgacagaaaatagcaatcagcctttctcacatcccaaagctttaaaaaatatatgagtgcagcatggccagtatggaattgaccaaaaactaatcatcaagctagaaacgtggtgagagaaaaaaaaagggcaagaatatctttggcttatcacctcccacttttgcctactaatctgatgctgaaaagaaatgctcactgaagcattttagattttgaatctttcagatttgggatgctaaaccagtaagcatatgacaaatatttcagaataaaaaaatgtcagaaatccaaaaca

SEQ ID NO: 168807 - DNA, 555 bp, Homo sapiens
  Payload ID: 13234
  Gene Symbol: PSG4
  Gene Name: pregnancy specific beta-1-glycoprotein 4
  ENST ID: ENST00000599391
  CDS Start-End: 16-555
caagcagcagagaccatggggcccctctcagcccctccctgcacacagcgcatcacctggaagggggtcctgctcacagtggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctct

SEQ ID NO: 168808 - DNA, 1626 bp, Homo sapiens
  Payload ID: 13235
  Gene Symbol: PSG5
  Gene Name: pregnancy specific beta-1-glycoprotein 5
  Uniprot ID: Q15238
  ENST ID: ENST00000342951
  CDS Start-End: 118-1125
ccctggagagaggctcagcacagaaggaggaaggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 168809 - DNA, 1766 bp, Homo sapiens
  Payload ID: 13235
  Gene Symbol: PSG5
  Gene Name: pregnancy specific beta-1-glycoprotein 5
  Uniprot ID: Q15238
  ENST ID: ENST00000366175
  CDS Start-End: 132-1139
gagaagtgctcctgccctggagagaggctcagcacagaaggaggaaggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgctccttcaggaataggacgtcttcctctccttaatccaatatagcagccgtgaagtcatttctgtatttcaggaagactggcagatggagtttcgctcttgttgcccatgctggagtgcaatggcacaatcttggctcaccgcaacctccgcctcctgtgttcaagtgattctcctgcttcagcctcccgagtactgggattacaggcatgcaccaacacgcccagctaattttgtattttcagtagagacagggtgtcttcatgttggtcaggctggtctcaaactcccgacctcaggtgatccgtacgcctcagcctctcaaagtactgggattacaggcctgagccaccgcacctggcccacacatttttacataccaagagatcctttaatccacccaaaggctgacgttagctgcatctgtaacacaactttttcctcaaatatatggagttttttttaggcttccacttctatacttccctattctcactccctgttttaatttaacatagacatgcaatgctagataatagaattgctctctaccagctgaacatttgggagcctgtgcagtttctggcccttcttgttgcacatagataaatacatccggtgttatagagactcagttgtaaaaatcaataaatgtgctgcctggttaaaatg

SEQ ID NO: 168810 - DNA, 2145 bp, Homo sapiens
  Payload ID: 13235
  Gene Symbol: PSG5
  Gene Name: pregnancy specific beta-1-glycoprotein 5
  ENST ID: ENST00000404580
  CDS Start-End: 90-1091
ggaaggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctggtaagtggatcccagcatccttggcaatagggttttaggtggagtctacctggctttcagagaagagttaggaaaacatttttattcccagcctgtgtcccatgggcacaagcaaatcccaaattctcctcctgaacccttccaatttgtctctacaaactctcttctccttgtttttctgttttctcatggctgaccttgtgtctggcctaagaaagttagggagggggctttatcagccctgagccctatgtggtagaggaggcttcacagagggatgagaaggagagtcctcaagatcaagttgcttctcgatgtcaccaacacatccccttctgccatgtctttgtttccttgtacctattccatgagctacaaggaacatctgaggctctgaaacaagctcacacttttcccccaaatgagacgaggaagccccttgggtgagggaggagcagctcagactctgcttcctgctctgctccatgcttctctggtgactgggcctgcctcactcaacctggggtgggaccagcatgtgtggagaaagagtcctggtggcctgtcctgaatttggctaaatcgagctgccagttgaagccaagcctcccccgggccaggctgcagggaaataagaagagagggagcctcagggaagactcctgcgttgcgtcctggctctgaagtcaccggttgtatgaggttgtgggcacagcatgtgggacacagcacggaggatagtgactgatgcagagctggagaaatagagagattcacccctggggctctgcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactcactccttctccccataacccttagcacacaccattctacattctgtctctatgtaactggctattctaactatcttttataaatggaattatatgataa

SEQ ID NO: 168811 - DNA, 1526 bp, Homo sapiens
  Payload ID: 13235
  Gene Symbol: PSG5
  Gene Name: pregnancy specific beta-1-glycoprotein 5
  Uniprot ID: Q15238
  ENST ID: ENST00000407356
  CDS Start-End: 86-1093
ggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 168812 - DNA, 1064 bp, Homo sapiens
  Payload ID: 13235
  Gene Symbol: PSG5
  Gene Name: pregnancy specific beta-1-glycoprotein 5
  ENST ID: ENST00000407568
  CDS Start-End: 90-563
ggaaggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttataccctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 168813 - DNA, 1884 bp, Homo sapiens
  Payload ID: 13235
  Gene Symbol: PSG5
  Gene Name: pregnancy specific beta-1-glycoprotein 5
  ENST ID: ENST00000599812
  CDS Start-End: 97-1383
agaaggaggaaggacagcacagcctacagccgtgctcaggaagtttctggatcctaggctcagctccacagaggagaacacgcaggcgcagagaccatggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctggaaactcccaagccctccatctccagtagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctcctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 168814 - DNA, 1674 bp, Homo sapiens
  Payload ID: 13236
  Gene Symbol: PSG6
  Gene Name: pregnancy specific beta-1-glycoprotein 6
  Uniprot ID: Q00889
  ENST ID: ENST00000187910
  CDS Start-End: 67-1341
ctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcagtaagaa

SEQ ID NO: 168815 - DNA, 1391 bp, Homo sapiens
  Payload ID: 13236
  Gene Symbol: PSG6
  Gene Name: pregnancy specific beta-1-glycoprotein 6
  Uniprot ID: Q00889
  ENST ID: ENST00000292125
  CDS Start-End: 46-1353
cctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatg

SEQ ID NO: 168816 - DNA, 1412 bp, Homo sapiens
  Payload ID: 13236
  Gene Symbol: PSG6
  Gene Name: pregnancy specific beta-1-glycoprotein 6
  ENST ID: ENST00000402603
  CDS Start-End: 91-1086
ggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttca

SEQ ID NO: 168817 - DNA, 2321 bp, Homo sapiens
  Payload ID: 13236
  Gene Symbol: PSG6
  Gene Name: pregnancy specific beta-1-glycoprotein 6
  ENST ID: ENST00000601833
  CDS Start-End: 1285-1506
ggaacccacagcccagcagtgtccaccctcaccagggtcacttcggcctaagtcctcagcgccctccatgctccccacacggactctgtcagctcctccctgacctgggggccaccaacctaacaccacgccctctgcaggtagctcctgccccacacacctgctccttccctgggcccagctaaaggcatctcccagggcagcgctggtgcacgcgatgccacactgggcgctttcccctcgtgacctccctccatcctcatcaactctttctgtcaccgctccctaaatgcccgcccctgctccatctgtcctgttccctggggcatcccaggccaagcttagcgctgacacagaatagcggctgcctgagggcccacagcctcaccgggaatcagccaggcaccctgtgacctgcctgcacgctgcaccccacggggctcagagcgcgtgtgatggtcacacacaggcaccatccgaggtgtggccacctatccccagctgtcccttgggaagacagacctctcctgtgtgcttgcggggagaagggggatgttattgctctttgctcccagaacacaactcaccccccacccgcccgctcaggtgtgagcaacgtccctccagacaggatctctggccactgcctgttcctcctctacacacagcagcttggccaggtcaaaaaccctcaggacagacccctgggtatgtcaacacatgaaaggctctgcccaacattgccacggagttggtcgggatgaatctctccagctctgaaactctgctccgacccaggctccccctcctgcgtctcaacgagccatgtcccaccgggttcctgtttaactcctcacttccttctgcaccaccacggagaagctgtggtgaccacaggacaatcagctgggcagagaagagaggacatcaaagatggtcaggaagaacatgagaaaccatgagctccagctcagccaccggaccccacggagtcatacagtgaccgagaactttccctttgactatgggactcacagccaccactgagcaacaggcacaggcctctcctcccaagaggcatgagagattcaccctgcacacctccaggaaggacagtttcctctgggacacccagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactgtgagtgattccgcatgatccctgggtgttggggggcaggggtcatttctacttcacacacacagaattgtcaggcctggactctgcctgtgtcactctctgcattatgtcccatgctggggtttgggcatttagtgcaggacacacacagaggagacacatttcaacagatcagaattcctttcccgcatccagaccctgcagacactcgctgcagaggaaggacagtctgatggggggactcagcaggaggagatcagtctcagccaagcacctcatgccctcttcataaatttgaccctgagaaagaccctggaaaactgagtagggcttggcctgaggggcccactgagataccctcagagaacctcagctctggaagcctcaatcccagacccctgtccctaaatccttgctccaggtaaagctgaggagcctgtgccaggactgggttgtggcttctttggcagggcttactgggaccaaggatttaccagctgtctgaggactgtgtctcctggagctgttcaccagccagggctcagtcctcagagcctcatctgggcaaggacagagctttcttcacctgacactcagagtggagaggacagaaagacaagctttgtaggccatcagccaactgccttaggaggcctaggacactccatagaaagtctaatatccccagaagcagaaacagaagagagaagatgcaccaggtagccgtttgtccacagggatctgacgcaaaggtgctttctcatggaagcaaattaataataaatgctgtttgtgtgaacacctccactgtgccaagcattaa

SEQ ID NO: 168818 - DNA, 568 bp, Homo sapiens
  Payload ID: 13236
  Gene Symbol: PSG6
  Gene Name: pregnancy specific beta-1-glycoprotein 6
  ENST ID: ENST00000594375
  CDS Start-End: 96-568
aaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcct

SEQ ID NO: 168819 - DNA, 1168 bp, Homo sapiens
  Payload ID: 13236
  Gene Symbol: PSG6
  Gene Name: pregnancy specific beta-1-glycoprotein 6
  ENST ID: ENST00000599753
  CDS Start-End: 1-245
tggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcat

SEQ ID NO: 168820 - DNA, 2025 bp, Homo sapiens
  Payload ID: 13237
  Gene Symbol: PSG7
  Gene Name: pregnancy specific beta-1-glycoprotein 7 (gene/pseudogene)
  ENST ID: ENST00000406070
  CDS Start-End: 98-1357
agaaggaggaaggacagcacagctgacagccgtgctcaggaagattctggatcctaggctcatctccacagaggagaacacgcagggagcagagaccatggggcccctctcagcccctccctgcacacagcatataacctggaaagggctcctgctcacagcatcacttttaaacttctggaacccgcccaccacagcccaagtcacgattgaagcccagccaccaaaagtttccgaggggaaggatgttcttctacttgtccacaatttgccccagaatcttactggctacatctggtacaaaggacaaatcagggacctctaccattatgttacatcatatatagtagacggtcaaataattaaatatgggcctgcatacagtggacgagaaacagtatattccaatgcatccctgctgatccagaatgtcacccaggaagacacaggatcctacactttacacatcataaagcgaggtgatgggactggaggagtaactggacgtttcaccttcaccttatacctggagactcccaaaccctccatctccagcagcaatttcaaccccagggaggccacggaggctgtgattttaacctgtgatcctgagactccagatgcaagctacctgtggtggatgaatggtcagagcctccctatgactcacagcttgcagctgtctgaaaccaacaggaccctctacctatttggtgtcacaaactatactgcaggaccctatgaatgtgaaatacggaacccagtgagtgccagccgcagtgacccagtcaccctgaatctcctcccgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagcttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctcaggaggaaatgtggctctctccatcttgcatacagggctcccaatagaaatgaacacagagatattgcctgtgtgtttgcagagaagatggtttctataaagagtaggaaagctgaaattatagtagactcccctttaaatgcacattgtgtggatggctctcaccatttcctaagagatacattgtaaaacgtgacagtaagactgattctagcagaataaaacatgtactaca

SEQ ID NO: 168821 - DNA, 2227 bp, Homo sapiens
  Payload ID: 13237
  Gene Symbol: PSG7
  Gene Name: pregnancy specific beta-1-glycoprotein 7 (gene/pseudogene)
  ENST ID: ENST00000446844
  CDS Start-End: 91-1371
ggaaggacagcacagctgacagccgtgctcaggaagattctggatcctaggctcatctccacagaggagaacacgcagggagcagagaccatggggcccctctcagcccctccctgcacacagcatataacctggaaagggctcctgctcacagcatcacttttaaacttctggaacccgcccaccacagcccaagtcacgattgaagcccagccaccaaaagtttccgaggggaaggatgttcttctacttgtccacaatttgccccagaatcttactggctacatctggtacaaaggacaaatcagggacctctaccattatgttacatcatatatagtagacggtcaaataattaaatatgggcctgcatacagtggacgagaaacagtatattccaatgcatccctgctgatccagaatgtcacccaggaagacacaggatcctacactttacacatcataaagcgaggtgatgggactggaggagtaactggacgtttcaccttcaccttatacctggagactcccaaaccctccatctccagcagcaatttcaaccccagggaggccacggaggctgtgattttaacctgtgatcctgagactccagatgcaagctacctgtggtggatgaatggtcagagcctccctatgactcacagcttgcagctgtctgaaaccaacaggaccctctacctatttggtgtcacaaactatactgcaggaccctatgaatgtgaaatacggaacccagtgagtgccagccgcagtgacccagtcaccctgaatctcctcccgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctggtaagtggatcccagcatccttggcaatagggttttaggtgcagtctatctgactttcagagaaaagtcaggaaaacatttgtattcccagcctgtgtcccatgggcacaagcaaatcccaaattttcctcctgaaccctccaaatttgtctaagaacttcgaaaactttaacaaacaggctgatatcttcataacattcccagcctagaccaagcaggaaaaacattgatttcattgaaataattgataataatgaggataatgtttttatgatttttatttgaaaatatgctgattctttatgtggatagttttctagatttatggaaatttgtcttttaatctatctctagcttatagtggttcaataaactatacttctgggaatgataattgaaatatttacttttgctctctacctgaatgccccagaattgggcaactattcatgagtattgatatgtttatggtaatacagatatttgcacaaacagagtaacaacctgctctctttgtaacaggacacatttcaaatcattggttatattaccaaggctttgactgggatgttatatttaagaatatagctagaatgaaccagtatgaactgcaggcaaactctgaagtcagccttggtttggcttcctattctcaagagttttgtaaaggtttaatctgagattccttataaaaacttacagcaaagaaaattttaaaagagagcctacatagtccattgctactcttgctgcacttatgtaaacaatcagaccaagtttgaagaaactcaacctattttgcaaacaaacttattctactgaaattatcattggtaaaactagagatgcccatagagagaaaaattatgtggaaaataaaaccgtagtacacct

SEQ ID NO: 168822 - DNA, 2036 bp, Homo sapiens
  Payload ID: 13237
  Gene Symbol: PSG7
  Gene Name: pregnancy specific beta-1-glycoprotein 7 (gene/pseudogene)
  ENST ID: ENST00000618424
  CDS Start-End: 103-1362
agtgcagaaggaggaaggacagcacagctgacagccgtgctcaggaagtttctggatcctaggctcatctccacagaggagaacacacaggcagcagagaccatggggcccctctcagcccctccctgcacagagcacatcaaatggaaggggctcctggtcacagcatcacttttaaacttctggaacctgcccaccactgcccaagtcacgattgaagcccagccaccaaaagtttccgaggggaaggatgttcttctacttgtccacaatttgccccagaatcttactggctacatctggtacaaagggcaaatcagggacctctaccattacattacatcatatgtagtagacggtcaaataattatatatgggcctgcatatagtggacgagaaacagcatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctcccgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagcttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctcaggaggaaatgtggctctctccatcttgcatacagggctcccaatagaaatgaacacagagatattgcctgtgtgtttgcagagaagatggtttctataaagagtaggaaagctgaaattatagtagactcccctttaaatgcacattgtgtggatggctctcaccatttcctaagagatacattgtaaaacgtgacagtaagactgattctagcagaataaaacatgtactacatttgct

SEQ ID NO: 168823 - DNA, 1441 bp, Homo sapiens
  Payload ID: 13237
  Gene Symbol: PSG7
  Gene Name: pregnancy specific beta-1-glycoprotein 7 (gene/pseudogene)
  ENST ID: ENST00000617049
  CDS Start-End: 99-1379
cagaaggaggaaggacagcacagctgacagccgtgctcaggaagattctggatcctaggctcatctccacagaggagaacacgcagggagcagagaccatggggcccctctcagcccctccctgcacacagcatataacctggaaagggctcctgctcacagcatcacttttaaacttctggaacccgcccaccacagcccaagtcacgattgaagcccagccaccaaaagtttccgaggggaaggatgttcttctacttgtccacaatttgccccagaatcttactggctacatctggtacaaaggacaaatcagggacctctaccattatgttacatcatatatagtagacggtcaaataattaaatatgggcctgcatacagtggacgagaaacagtatattccaatgcatccctgctgatccagaatgtcacccaggaagacacaggatcctacactttacacatcataaagcgaggtgatgggactggaggagtaactggacgtttcaccttcaccttatacctggagactcccaaaccctccatctccagcagcaatttcaaccccagggaggccacggaggctgtgattttaacctgtgatcctgagactccagatgcaagctacctgtggtggatgaatggtcagagcctccctatgactcacagcttgcagctgtctgaaaccaacaggaccctctacctatttggtgtcacaaactatactgcaggaccctatgaatgtgaaatacggaacccagtgagtgccagccgcagtgacccagtcaccctgaatctcctcccgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcc

SEQ ID NO: 168824 - DNA, 1392 bp, Homo sapiens
  Payload ID: 13237
  Gene Symbol: PSG7
  Gene Name: pregnancy specific beta-1-glycoprotein 7 (gene/pseudogene)
  ENST ID: ENST00000623675
  CDS Start-End: 23-916
gaacacgcagggagcagagaccatggggcccctctcagcccctccctgcacacagcatataacctggaaagggctcctgctcacagtggagactcccaaaccctccatctccagcagcaatttcaaccccagggaggccacggaggctgtgattttaacctgtgatcctgagactccagatgcaagctacctgtggtggatgaatggtcagagcctccctatgactcacagcttgcagctgtctgaaaccaacaggaccctctacctatttggtgtcacaaactatactgcaggaccctatgaatgtgaaatacggaacccagtgagtgccagccgcagtgacccagtcaccctgaatctcctcccgaagctgcccaagccctacatcaccatcaataacttaaaccccagggagaataaggatgtctcaaccttcacctgtgaacctaagagtgagaactacacctacatttggtggctaaatggtcagagcctcccggtcagtcccagggtaaagcgacgcattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagcttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctcaggaggaaatgtggctctctccatcttgcatacagggctccca

SEQ ID NO: 168825 - DNA, 1441 bp, Homo sapiens
  Payload ID: 13238
  Gene Symbol: PSG8
  Gene Name: pregnancy specific beta-1-glycoprotein 8
  Uniprot ID: Q9UQ74
  ENST ID: ENST00000306511
  CDS Start-End: 99-1379
cagaaggaggcaggacagcactgctgagagctgtgctcaggaagcttctggatcctaggctcatctccacagaggagaacacacagacagcagagaccatggggctcctctcagcccctccctgcacacagcgcatcacctggaaggggctcctgctcacagcatcacttttaaacttctggaacccacccacgactgcccaagtcacgattgaagcccagccaaccaaagtttctgaggggaaggatgttcttctacttgtccacaatttgccccagaatcttactggctacatctggtacaaagggcaaatcagggacctctaccattacattacatcatatgtagtagacggtcaaataattatatatgggcctgcatacagtggacgagaaacaatatattccaatgcatccctgctgatccagaatgtcacccaggaagacgcaggatcctacaccttacacatcataatgggaggtgatgagaatagaggagtaactggacatttcaccttcaccttatatctggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccattcaccctgaatctcctcccgaagctgcccaagccctacatcaccatcaacaacttaaaacccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagttacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctggtaagcggatcccagtatccttggcaatagggatttaggtggagtctatctggccttcagggaagagtcaggaaaacatttttattcccagcctgcgtcc

SEQ ID NO: 168826 - DNA, 1610 bp, Homo sapiens
  Payload ID: 13238
  Gene Symbol: PSG8
  Gene Name: pregnancy specific beta-1-glycoprotein 8
  Uniprot ID: Q9UQ74
  ENST ID: ENST00000406636
  CDS Start-End: 82-975
gcactgctgagagctgtgctcaggaagcttctggatcctaggctcatctccacagaggagaacacacagacagcagagaccatggggctcctctcagcccctccctgcacacagcgcatcacctggaaggggctcctgctcacagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccattcaccctgaatctcctcccgaagctgcccaagccctacatcaccatcaacaacttaaaacccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagttacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggctctcgccatttcctaagagatacattgtaaaatgtgacagtaatactg

SEQ ID NO: 168827 - DNA, 2031 bp, Homo sapiens
  Payload ID: 13238
  Gene Symbol: PSG8
  Gene Name: pregnancy specific beta-1-glycoprotein 8
  Uniprot ID: Q9UQ74
  ENST ID: ENST00000404209
  CDS Start-End: 98-1357
agaaggaggcaggacagcactgctgagagctgtgctcaggaagcttctggatcctaggctcatctccacagaggagaacacacagacagcagagaccatggggctcctctcagcccctccctgcacacagcgcatcacctggaaggggctcctgctcacagcatcacttttaaacttctggaacccacccacgactgcccaagtcacgattgaagcccagccaaccaaagtttctgaggggaaggatgttcttctacttgtccacaatttgccccagaatcttactggctacatctggtacaaagggcaaatcagggacctctaccattacattacatcatatgtagtagacggtcaaataattatatatgggcctgcatacagtggacgagaaacaatatattccaatgcatccctgctgatccagaatgtcacccaggaagacgcaggatcctacaccttacacatcataatgggaggtgatgagaatagaggagtaactggacatttcaccttcaccttatatctggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccattcaccctgaatctcctcccgaagctgcccaagccctacatcaccatcaacaacttaaaacccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagttacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggctctcgccatttcctaagagatacattgtaaaatgtgacagtaatactgattctagcagaataaaacatgtaccacatttgctaatac

SEQ ID NO: 168828 - DNA, 1686 bp, Homo sapiens
  Payload ID: 13238
  Gene Symbol: PSG8
  Gene Name: pregnancy specific beta-1-glycoprotein 8
  ENST ID: ENST00000401467
  CDS Start-End: 73-1053
acagccgtgctcaggaagtttctggaacctaggctcatctccacagaggagaacacacaagcagcagagaccatggggcccctctcagcccctccctgcacacagcacatcaaatggaagggggtcctgctcacagcatcacttttaaacttctggaacccacccacgactgcccaagtcacgattgaagcccagccaaccaaagtttctgaggggaaggatgttcttctacttgtccacaatttgccccagaatcttactggctacatctggtacaaagggcaaatcagggacctctaccattacattacatcatatgtagtagacggtcaaataattatatatgggcctgcatacagtggacgagaaacaatatattccaatgcatccctgctgatccagaatgtcacccaggaagacgcaggatcctacaccttacacatcataatgggaggtgatgagaatagaggagtaactggacatttcaccttcaccttatatccgaagctgcccaagccctacatcaccatcaacaacttaaaacccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagttacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggctctcgccatttcctaagagatacattgtaaaatgtgacagtaatac

SEQ ID NO: 168829 - DNA, 1046 bp, Homo sapiens
  Payload ID: 13238
  Gene Symbol: PSG8
  Gene Name: pregnancy specific beta-1-glycoprotein 8
  ENST ID: ENST00000478387
  CDS Start-End: 89-211
caggacagcactgctgagagctgtgctcaggaagcttctggatcctaggctcatctccacagaggagaacacacagacagcagagaccatggggctcctctcagcccctccctgcacacagcgcatcacctggaaggggctcctgctcacaggtcattccttggactctgctctatctttagaggtcactggctcaagtcagccactatgagacacctgggaaaactgcgccaccttgtggctccactgcctgatgactgaactgacctccggacttgactctgttctcccctgtgttatttctgctgaagtacccagtcccaggccaggctttccagtacccaaagggtttaaagacaattggaagttccatcacccatctctaggatgtccttggcaagggaagctgcagagaaaacataccttgggcggcaaagtaagactgaaactaagaagattccagcactgcatgctccaagtgaggaccacaagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccattcaccctgaatctcctcccgaagctgcccaagccctacatcaccatcaacaacttaaaacccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagttacccagtcaccctgaatgtc

SEQ ID NO: 168830 - DNA, 2073 bp, Homo sapiens
  Payload ID: 13239
  Gene Symbol: PSG9
  Gene Name: pregnancy specific beta-1-glycoprotein 9
  Uniprot ID: Q00887
  ENST ID: ENST00000244293
  CDS Start-End: 68-1276
cgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtaagtggatcccagcatccttggcagtagggttttatgtggagtctatctggctttcagagaagagtcaggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaaggagagtcctcaagatcaagttgcttctcgctgtcaccgacacatccccttctgccacgtcttttttttcttgtacctattccatgagctacaagggacagctgaggctttgaaacaagctcacacttttcccccagatgagaggaggaagccccttgggtgagggaggagcagctcagactctgcttcctgctctgctccgggctcctctggtgactggccctgcctcactcaacctggggtgggactagcgtgtgtgtagaaagggccctggtggcctgtcctgaatttggctaaattgagctgccagttgaagccaagcctcccccgggccaggctgcagggaaataagaagagagggagcctcagggcagactcctgagctgcgtcctggctctgaagtcaccagctgtatgaggctttgggcacagcacgtgggacacagcacggaggacagtgactgatgcagagctggaggaatagggagattcaccgttggggttattcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactctcactccttcttcccctaacccttagcacccatcattctactttgtctc

SEQ ID NO: 168831 - DNA, 1705 bp, Homo sapiens
  Payload ID: 13239
  Gene Symbol: PSG9
  Gene Name: pregnancy specific beta-1-glycoprotein 9
  Uniprot ID: Q00887
  ENST ID: ENST00000270077
  CDS Start-End: 98-1378
agaaggaggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaa

SEQ ID NO: 168832 - DNA, 1055 bp, Homo sapiens
  Payload ID: 13239
  Gene Symbol: PSG9
  Gene Name: pregnancy specific beta-1-glycoprotein 9
  ENST ID: ENST00000291752
  CDS Start-End: 7-729
gagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatactatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgta

SEQ ID NO: 168833 - DNA, 1421 bp, Homo sapiens
  Payload ID: 13239
  Gene Symbol: PSG9
  Gene Name: pregnancy specific beta-1-glycoprotein 9
  ENST ID: ENST00000443718
  CDS Start-End: 98-1099
agaaggaggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatactcgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttc

SEQ ID NO: 168834 - DNA, 1748 bp, Homo sapiens
  Payload ID: 13239
  Gene Symbol: PSG9
  Gene Name: pregnancy specific beta-1-glycoprotein 9
  ENST ID: ENST00000418820
  CDS Start-End: 100-1080
acagaaggaggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatactcgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgactggatattaccctgaattctactagttcctccaattccattttctcccatggaatcacgaagagcaagacccactctgttccagaagtcctataagcgggaggtggacaactcaatgtaaatttcatgggaaaacccttgtacctgaagcgtgagccactcagaactcaccaaaatgttcgacaccataacaacagctgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgaggataacaacagagtgtcagatatgtcgtctcaacctcaaacttttacgtaaaatctcaggggaaatgtggctctctccaccttgcatacagggctcccaatagaaatgaatacagagatattgcctgtgtgtttgcagagaagatggtttctataaagagtaggaaagctgaaattatagtagagtcccctttaaatgcacattgtgtggatgactcttgccatttcctaagagatacattgtaaaacgtgacagtaagactgattctagcagaataaaacatgtaccacatttgct

SEQ ID NO: 168835 - DNA, 1812 bp, Homo sapiens
  Payload ID: 13239
  Gene Symbol: PSG9
  Gene Name: pregnancy specific beta-1-glycoprotein 9
  ENST ID: ENST00000596730
  CDS Start-End: 91-1020
ggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatactatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtaagtggatcccagcatccttggcagtagggttttatgtggagtctatctggctttcagagaagagtcaggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaaggagagtcctcaagatcaagttgcttctcgctgtcaccgacacatccccttctgccacgtcttttttttcttgtacctattccatgagctacaagggacagctgaggctttgaaacaagctcacacttttcccccagatgagaggaggaagccccttgggtgagggaggagcagctcagactctgcttcctgctctgctccgggctcctctggtgactggccctgcctcactcaacctggggtgggactagcgtgtgtgtagaaagggccctggtggcctgtcctgaatttggctaaattgagctgccagttgaagccaagcctcccccgggccaggctgcagggaaataagaagagagggagcctcagggcagactcctgagctgcgtcctggctctgaagtcaccagctgtatgaggctttgggcacagcacgtgggacacagcacggaggacagtgactgatgcagagctggaggaatagggagattcaccgttggggttattcatggcaggaaaggggcagtgccaaaaagtgtgtaattatagagagggtaagactaccagacactttatatatatctaatataagacttaccattaactatttctatgtgtgcaatttagtgttgtgtaaccatcacactatccatttccagaactttttcctcttaccatattaaacctctgtacccaataaacagtaactctcactccttcttcccctaacccttagcacccatcattctacttt

SEQ ID NO: 168836 - DNA, 1429 bp, Homo sapiens
  Payload ID: 13239
  Gene Symbol: PSG9
  Gene Name: pregnancy specific beta-1-glycoprotein 9
  ENST ID: ENST00000593948
  CDS Start-End: 98-1099
agaaggaggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttccgtaagaa

SEQ ID NO: 168837 - DNA, 2019 bp, Homo sapiens
  Payload ID: 13239
  Gene Symbol: PSG9
  Gene Name: pregnancy specific beta-1-glycoprotein 9
  ENST ID: ENST00000621109
  CDS Start-End: 93-1352
gaggaaggacagcacagctgacagccgtgctcagacagcttctggatcccaggctcatctccacagaggagaacacacaggcagcagagaccatggggcccctcccagccccttcctgcacacagcgcatcacctggaaggggctcctgctcacagcatcacttttaaacttctggaacccgcccaccactgccgaagtcacgattgaagcccagccacccaaagtttctgaggggaaggatgttcttctacttgtccacaatttgccccagaatcttcctggctacttctggtacaaaggggaaatgacggacctctaccattacattatatcgtatatagttgatggtaaaataattatatatgggcctgcatacagtggaagagaaacagtatattccaacgcatccctgctgatccagaatgtcacccggaaggatgcaggaacctacaccttacacatcataaagcgaggtgatgagactagagaagaaattcgacatttcaccttcaccttatacttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcagtgacccagtcaccctgaatctcctcccgaagctgcccatcccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctgactggatattaccctgaattctactagttcctccaattccattttctcccatggaatcacgaagagcaagacccactctgttccagaagtcctataagcgggaggtggacaactcaatgtaaatttcatgggaaaacccttgtacctgaagcgtgagccactcagaactcaccaaaatgttcgacaccataacaacagctgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgaggataacaacagagtgtcagatatgtcgtctcaacctcaaacttttacgtaaaatctcaggggaaatgtggctctctccaccttgcatacagggctcccaatagaaatgaatacagagatattgcctgtgtgtttgcagagaagatggtttctataaagagtaggaaagctgaaattatagtagagtcccctttaaatgcacattgtgtggatgactcttgccatttcctaagagatacattgtaaaacgtgacagtaagactgattctagcagaataaaacatgtaccacatttgc

SEQ ID NO: 168838 - DNA, 1508 bp, Homo sapiens
  Payload ID: 13240
  Gene Symbol: PNCK
  Gene Name: pregnancy up-regulated nonubiquitous CaM kinase
  Uniprot ID: Q6P2M8
  ENST ID: ENST00000340888
  CDS Start-End: 69-1100
ggggcgcgggcggggggcttggcgctgcggccactgcgcggcacgacgctgcggcacccgctccagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaatgg

SEQ ID NO: 168839 - DNA, 1525 bp, Homo sapiens
  Payload ID: 13240
  Gene Symbol: PNCK
  Gene Name: pregnancy up-regulated nonubiquitous CaM kinase
  Uniprot ID: Q6P2M8
  ENST ID: ENST00000370142
  CDS Start-End: 55-1155
atgatctcaataaaaggaatgctctggctgctgggtagagaagaaagcgaggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctcc

SEQ ID NO: 168840 - DNA, 1455 bp, Homo sapiens
  Payload ID: 13240
  Gene Symbol: PNCK
  Gene Name: pregnancy up-regulated nonubiquitous CaM kinase
  Uniprot ID: Q6P2M8
  ENST ID: ENST00000370145
  CDS Start-End: 19-1101
agcagctgtaggcctgggatgtggaggcgtgtatgcggtggcctcgctgggaggcgtccgtctggggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatgg

SEQ ID NO: 168841 - DNA, 1612 bp, Homo sapiens
  Payload ID: 13240
  Gene Symbol: PNCK
  Gene Name: pregnancy up-regulated nonubiquitous CaM kinase
  Uniprot ID: Q6P2M8
  ENST ID: ENST00000370150
  CDS Start-End: 180-1211
agcacacctgtcacgcctggcgcgccccctgcccgcacgcgctcggtccacgcagctcgggacgcgggcggcccaggctgccaggtccccctgctccgcggcgccgagggctgggctgcgtctgcggccgcgtgggtggccgcggtcttggcaggtggctgcgcgcgggggtcgcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaa

SEQ ID NO: 168842 - DNA, 326 bp, Homo sapiens
  Payload ID: 13240
  Gene Symbol: PNCK
  Gene Name: pregnancy up-regulated nonubiquitous CaM kinase
  ENST ID: ENST00000438984
  CDS Start-End: 1-244
gatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcgggcctcaggggctgtctttcctgcacggctgttgtgtgcttcgctgagtgtgggtggtcctgcttgtgtcatggtcatggccttccagccccctccagttttccccaaaccaataaagaaagatacagc

SEQ ID NO: 168843 - DNA, 557 bp, Homo sapiens
  Payload ID: 13240
  Gene Symbol: PNCK
  Gene Name: pregnancy up-regulated nonubiquitous CaM kinase
  ENST ID: ENST00000411968
  CDS Start-End: 47-295
cgctgcggccactgcgcggcacgacgctgcggcacccgctccagacatgctgctgctgaagaaacacacggaggacatcagcagcgtctacgagatccgcgagaggctcggctcgagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggcccc

SEQ ID NO: 168844 - DNA, 771 bp, Homo sapiens
  Payload ID: 13240
  Gene Symbol: PNCK
  Gene Name: pregnancy up-regulated nonubiquitous CaM kinase
  ENST ID: ENST00000422811
  CDS Start-End: 99-771
ggctgaggcctgcctggcagggggtggaggaggaagctgcccttgcccccggcggggcggggagagacccccatcacctctcccctgcccctgcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcc

SEQ ID NO: 168845 - DNA, 448 bp, Homo sapiens
  Payload ID: 13240
  Gene Symbol: PNCK
  Gene Name: pregnancy up-regulated nonubiquitous CaM kinase
  ENST ID: ENST00000423545
  CDS Start-End: 321-448
tctccccgctcctggcaggctgcagccgtctcctcccggtgctccctccttccttgagctctctccaccgctgcccactgggggctacagcttcccggctaccctggaagctggaggccgggaccagctcttcagggtcttctctggcccagcctttgactgaagctggtctggagacaggggcattagagaagtgactcatagatggcctaaagaagcggggccactcaaggacccaggacagagggaagagggccaacccagctggaccacaggcaaaccccattgcctttgagagaaagaagaggacccggtgaaacatgctgctgctgaagaaacacacggaggacatcagcagcgtctacgagatccgcgagaggctcggctcgggtgccttctccgaggtggtgctggcccaggagcggggctccgcacacctcgtggccct

SEQ ID NO: 168846 - DNA, 311 bp, Homo sapiens
  Payload ID: 13240
  Gene Symbol: PNCK
  Gene Name: pregnancy up-regulated nonubiquitous CaM kinase
  ENST ID: ENST00000434652
  CDS Start-End: 53-311
cggatgtgtggaggcagagaggcagcatccaggcgctggtcgccttcgggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctct

SEQ ID NO: 168847 - DNA, 717 bp, Homo sapiens
  Payload ID: 13240
  Gene Symbol: PNCK
  Gene Name: pregnancy up-regulated nonubiquitous CaM kinase
  ENST ID: ENST00000433470
  CDS Start-End: 23-322
cgctgcggcacccgctccagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggcgcttccttgccattgcaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctg

SEQ ID NO: 168848 - DNA, 561 bp, Homo sapiens
  Payload ID: 13240
  Gene Symbol: PNCK
  Gene Name: pregnancy up-regulated nonubiquitous CaM kinase
  ENST ID: ENST00000419804
  CDS Start-End: 141-268
ctttctccccgctcctggcaggctgcagccgtctcctcccggtgctccctccttccttgagctctctccaccgctgcccactgggggctacagcttcccggctaccctggaagctggaggccgggaccagctcttcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtgggagccggggagggactgagcagtgagtggggctgaaggccaggctgagtgcctgggtcagccaaacccctggcacccccagggtgacgggtggcgagctgtttgaccgcatcatggagcg

SEQ ID NO: 168849 - DNA, 498 bp, Homo sapiens
  Payload ID: 13240
  Gene Symbol: PNCK
  Gene Name: pregnancy up-regulated nonubiquitous CaM kinase
  ENST ID: ENST00000458354
  CDS Start-End: 199-326
ggaggcgcccggcccggccaccgagcggcagcggcggacgaggggcggccccgacccccgcgtgcccgggggccacccgttgcccggacttcacccctccgcggcggctccgggggtcgggcgggggccggcggcctgctgggggaggaggccgcggcgggcgggggaactcacctccgccgttcttgtagcacagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtg

SEQ ID NO: 168850 - DNA, 1585 bp, Homo sapiens
  Payload ID: 13240
  Gene Symbol: PNCK
  Gene Name: pregnancy up-regulated nonubiquitous CaM kinase
  Uniprot ID: Q6P2M8
  ENST ID: ENST00000447676
  CDS Start-End: 187-1467
gacttggattgacatagagagctgcaggagggtgacatgatctcaataaaaggaatgctctggctgctgggtagagaagaaagcgagggtgagggattaatggtggagccagagggagcccagtgagtgccgggagcccagggtggcagagctgtggtgcagggttgcagggtcctggagctaggcatggaggctgctttcgggcaagtggccgggtcagcctgtcctcggagaggcggtgaaggcagagactggaaggcagagagccttgccgacctgtggccgaagagctctccgggagacagccaccggtggtgcaaaggccctggggccggcccagccgggccgcagctccgggaggcggcgcgagcgagcagtgggctgggcggtggcggccggcacccgagccggatcccggcgattgccttacaagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatt

SEQ ID NO: 168851 - DNA, 725 bp, Homo sapiens
  Payload ID: 13240
  Gene Symbol: PNCK
  Gene Name: pregnancy up-regulated nonubiquitous CaM kinase
  ENST ID: ENST00000425526
  CDS Start-End: 498-625
ccccgctcctggcaggctgcagccgtctcctcccggtgctccctccttccttgagctctctccaccgctgcccactgggggctacagcttcccggctaccctggaagctggaggccgggaccagctcttcaggtgacaggcctctgtgtctccacagtgggcagaggggagcctgcctggctgatgagcaagcctcgactttgtcatcaaggcagagaaggggcccgggtaaatgaccccggcggcccccacccctgcctggcgtgagagtgggtaggggcttcggacttgaggggactggagcgggaacaaggcaaggctgccccctgcctttgactgaagctggtctggagacaggggcattagagaagtgactcatagatggcctaaagaagcggggccactcaaggacccaggacagagggaagagggccaacccagctggaccacaggcaaaccccattgcctttgagagaaagaagaggacccggtgaaacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctg

SEQ ID NO: 168852 - DNA, 566 bp, Homo sapiens
  Payload ID: 13240
  Gene Symbol: PNCK
  Gene Name: pregnancy up-regulated nonubiquitous CaM kinase
  ENST ID: ENST00000418241
  CDS Start-End: 283-566
gaggtctggaaaaatgattttttaaaaactcttcctgccccgtggactctcttgaagacgtcgtgtcatgccagggcccacggtcacttgacggaacccttgtgatgctggccacaacctcatgggactggatggcgagcagcgaggggggtccagtaactgttggatgcaggattgaattcggtcacccgcacttatttcctgggctcgtcttggttgggttcgcggagatacactctctgggagcggacgctttggtgaggaagaccaggcgaagaagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggcgcttccttgccattgcaggatcagtcaccccaacatcgtcgctctggaggatgtccacgagagcccttcccacctctacctg

SEQ ID NO: 168853 - DNA, 754 bp, Homo sapiens
  Payload ID: 13240
  Gene Symbol: PNCK
  Gene Name: pregnancy up-regulated nonubiquitous CaM kinase
  ENST ID: ENST00000439087
  CDS Start-End: 77-754
ctggaaagcggccggatgtgtggaggcagagaggcagcatccaggcgctggtcgccttcggggtgcgggggaggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagg

SEQ ID NO: 168854 - DNA, 10959 bp, Homo sapiens
  Payload ID: 13241
  Gene Symbol: PAPPA
  Gene Name: pregnancy-associated plasma protein A, pappalysin 1
  Uniprot ID: Q13219
  ENST ID: ENST00000328252
  CDS Start-End: 370-5253
gggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtggaaaggggggctcgcccaagaagggtgaagaagcgaagaaagtcgaggcgccgaggctcccaaagctggcagctccgggtggcggtgcaggggcgaagggggggcggggggaaccgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaagagaattgggatcagcatgtcatctttgcctggaagggagaatcctggtgcagtatgcttccaacgcttcctccccaatgccctgcagcccatcaggacactggagccctcgtgaagcagaaggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatggatctaaatcttggcagtgtgtaccagtattgggtcataactatttcaggaactgaagagagtgagccatcacctgctgtcacatacatccatggaagtgggtactgtggcgatggcattatacaaaaagaccaaggtgaacaatgcgacgacatgaataagatcaatggtgatggctgctcccttttctgccgacaagaagtctccttcaattgtattgatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtgtgtcgaaccaaggtgatagatctcagtgaaggcatttcccagcatgcctggtacccttgcaccatcagctacccatattcccagctggctcagaccactttttggctccgggcgtatttttctcaaccaatggttgccgcagctgtcattgtccacctggtgacggatgggacatattatggggaccaaaagcaggagaccatcagcgtgcagctgcttgataccaaagatcagagccacgatctaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagagctgcgtgcacttcgcatgtgagaaaactgactgtccagagctggctgtggagaatgcttctctcaattgctccagcagcgaccgctaccacggtgcccagtgtactgtgagctgccggacaggctacgtgctccagatacggcgggatgatgagctgatcaagagccagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaaacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccatagggtcggagtgtgccacctcgtgcctggaccacaacagcgagtccatcatcctgccaatgaacgtgaccgtgcgtgacatcccccactggctgaaccccacacgggtagagagagttgtctgcactgctggtctcaagtggtatcctcaccctgctctgattcactgtgtcaaaggctgtgagcccttcatgggagacaattattgtgatgccatcaacaaccgagccttttgcaactatgacggtggggattgctgcacctccacagtgaagaccaaaaaggtcaccccattccctatgtcctgtgatctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggctttgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagcctcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattatgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattcttctggcctattgtaaaaaagaaaaaaaaaaagaaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgcttcag

SEQ ID NO: 168855 - DNA, 4610 bp, Homo sapiens
  Payload ID: 13242
  Gene Symbol: PZP
  Gene Name: pregnancy-zone protein
  Uniprot ID: P20742
  ENST ID: ENST00000261336
  CDS Start-End: 30-4478
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggtgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtccgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtcagtgtgcagctgaaagcctctccagccttcctagcttcccaaaatacaaagggagaagaatcctattgtatctgtggaaatgagagacaaaccttgtcttggacagtgactcctaaaactctggggaatgtgaacttctcagtgagtgcagaggcaatgcagtccttagaactctgtggaaatgaggttgttgaggtccctgagattaaaagaaaagacacagtcatcaaaaccctgttggtggaggctgaaggtattgagcaagaaaagactttcagttctatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccaaacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaacta

SEQ ID NO: 168856 - DNA, 4417 bp, Homo sapiens
  Payload ID: 13242
  Gene Symbol: PZP
  Gene Name: pregnancy-zone protein
  ENST ID: ENST00000535230
  CDS Start-End: 25-459
caaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacaggtaagtagggaaattccactgtttggggcaacactgagaagggccacctgaacagccaaagtctccattatcctagccccgtagcctcctgtcttattacccaaattacctgctttatcatgtctgaatcttatcggagaactacttttccagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggtgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtccgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggctgaaggtattgagcaagaaaagactttcagttctatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccaaacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcct

SEQ ID NO: 168857 - DNA, 1261 bp, Homo sapiens
  Payload ID: 13243
  Gene Symbol: PRELID1
  Gene Name: PRELI domain containing 1
  Uniprot ID: Q9Y255
  ENST ID: ENST00000303204
  CDS Start-End: 213-872
actgtgtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccgattcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcctctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattcagttggcccca

SEQ ID NO: 168858 - DNA, 886 bp, Homo sapiens
  Payload ID: 13243
  Gene Symbol: PRELID1
  Gene Name: PRELI domain containing 1
  ENST ID: ENST00000504594
  CDS Start-End: 172-501
catggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatgtggctggactgaaatccgccgggaagcctgggtctcctctagcttatttggtgtctccagagctgtccaggaatttggtcttgcccgattcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcctctctgccctcccttcattgtactttatcattaaaaatcaacttccagccctgtc

SEQ ID NO: 168859 - DNA, 712 bp, Homo sapiens
  Payload ID: 13243
  Gene Symbol: PRELID1
  Gene Name: PRELI domain containing 1
  ENST ID: ENST00000510797
  CDS Start-End: 176-289
aactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagtctcttaggggcaagcttctgagggtcaccttcaccctgacacctgcagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccgattcaaaagcaacgtgaccaagactatgaagggttttga

SEQ ID NO: 168860 - DNA, 608 bp, Homo sapiens
  Payload ID: 13243
  Gene Symbol: PRELID1
  Gene Name: PRELI domain containing 1
  ENST ID: ENST00000503853
  CDS Start-End: 1-608
ccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccgattcaaaagcaacgtgaccaagactatgaagggttttgaatatatcttggctaagctgcaagggaaattaggttggtctttcaggcatcttctaaaggcagccacctgccgttcgcgacaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcc

SEQ ID NO: 168861 - DNA, 1171 bp, Homo sapiens
  Payload ID: 13243
  Gene Symbol: PRELID1
  Gene Name: PRELI domain containing 1
  Uniprot ID: Q9Y255
  ENST ID: ENST00000503216
  CDS Start-End: 166-792
ggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccgattcaaaagcaacgtgaccaagactatgaagggttttgaatatatcttggctaagctgcaagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcctctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 168862 - DNA, 2140 bp, Homo sapiens
  Payload ID: 13244
  Gene Symbol: PRELID2
  Gene Name: PRELI domain containing 2
  Uniprot ID: Q8N945
  ENST ID: ENST00000334744
  CDS Start-End: 54-623
agctctgagctcgcggaggcgtggccggtgcgcggggcccgcggcgcgcggggatgggggtctcggtggatgtgcaccaggtgtacaagtaccccttcgagcaggtggtcgccagctttctccgaaagtaccccaaccccatggataaaaatgtcatctcagtaaaaatcatggaggaaaaaagagatgaatcaacaggggtcatctacagaaagaggattgcaatctgtcagaacgtggttccagaaattttaaggaagtccttaagcactctggtgattctttgttggaaaaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttatttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagaaccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgtgatttggtcctctggaaaaaaaaaaatgaaatgaagagtgggaaggcagtttcttttctgctaattcgttctgtgatggtgagcaagcaaatcattaacctctctgttttttattgggcaaatggggataatcaggcacaggtctttccgccaatgcgttatgatgattaaagaaggtaattttgtgcagggttttaagtcaacagacagacctgggtttgaatccaagtgctggcacctacttgctcagtgatcatgaacacaattttaaatctttctgaatctcatttaaaaaaatttgtgaaacaagatgatagaattaattttgtgagattgttggactgatttgagatcatgcctatgaagtacctagcacactgcctagtacatagtagaagtccaggaaatggaagccattattatgtaaaacattttgcaaaggtactttttaactgtaacgtaaagtggtactactgtttgaaacttagatggcagtagtttgcatttctcgtgatcagaagccaaaatataaatacatactacctaaaaaatcttgaagagaggtaataatttgaaattcatcttcttaagataaaaatcagggcagggtgtggtggcttatgcctgtaatcccagtactttgggaggccgaggcgggtggatcacaaggtcaggagttcgagaccagcctggccaatatggtgaaaccccgtctctactaaaaatacaaaaaaattagctgggcgtggtggcgcatgcctgtaatcctagctacttgggagtctgaggcaggagaattgcttgaactcaggaggtgaaggttgcagtaagctgagattgtgccactgcaccccagcctgggtgacagagcaagactccatcac

SEQ ID NO: 168863 - DNA, 1102 bp, Homo sapiens
  Payload ID: 13244
  Gene Symbol: PRELID2
  Gene Name: PRELI domain containing 2
  Uniprot ID: Q8N945
  ENST ID: ENST00000394450
  CDS Start-End: 376-822
gggcgcctccgggcctctgcggagccctgggcagctctgagctcgcggaggcgtggccggtgcgcggggcccgcggcgcgcggggatgggggtctcggtggatgtgcaccaggtgtacaagtaccccttcgagcaggtggtcgccagctttctccgaaaggtttccacgctttgagaaggactgaatgagatcatgcgcatggcagcttctctaggatagcaccctgcgtgaacacagtagctgctcagttaagtctttgatgggtgtgatcctgattcagcttgatcaattctgcagtcatactggattgtgtttgaaaaggtgtccagaaaaacctggccatctgcctcctgtcttcccagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcagagagctgtatccatgtctacttatttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaa

SEQ ID NO: 168864 - DNA, 1894 bp, Homo sapiens
  Payload ID: 13244
  Gene Symbol: PRELID2
  Gene Name: PRELI domain containing 2
  ENST ID: ENST00000511435
  CDS Start-End: 54-548
agctctgagctcgcggaggcgtggccggtgcgcggggcccgcggcgcgcggggatgggggtctcggtggatgtgcaccaggtgtacaagtaccccttcgagcaggtggtcgccagctttctccgaaagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaaggtaaccatatttctgctttgaaccaacattaattttaaaaaacaataggagttccaatagggttattgaataagactcatgagcagacataatgagaaaaacatatagttaataaacaaatatatgcaaaaataatcaacctcaaaattattacataaattcaaatcaaagtaaaactaaagtggcatttatggctcattaaattaaaaatatgccaatgaagagtatgtgaaaatttggagcatacttataatctaattaaaagaaataatcagaatgaataataatgtatagtatgatgacaactatttaataaagataatgatagttaatatttattgagcacttactatgtactactgactgctaaaagaatttgtattattaactcattgaatcctcacaaacctttgcaggagctgttattgttgtcctaatattatggatgaggaaaatacagagaccccaattgtccactcttatagttttcaaactctattctcaagggagcttaggcttccatgaaagtgattcagaagccatgttggagttctaaggtcctgtgtgctctattttaagtagagcttttccattttaatctgtcctctatggtattccatataacatttatatcttctattttctttccttaatagcattatttttaaaacttcatgtcaaaacccattgcttatgcatttttatgtgcttattgcagtgctcagtataaagcagttgctcctaagtgttttattattgttattaattacgatgataattatactcatttatttccagattttactcaggactttttgtataagtttacctcattttgttttgtgggatagaattaaccgctggtgtaaagaaccattgttatgaccctcagagacttcctggcaatggacccttgttttcatttttgcatgtctaggttcaaggatgaacctgtactaggaggtgttcatctgggaggctgagggcggtgaatgaatattcagtaccgttctgtacaccatagacatactgttgtgattgatgatgtgttcttgctccagttgaggtggttcctggcacatattcagactggtccagcctctttaaacctggacttgaagggagtagttgaacttccggaagatcttatgtcacctttactcactcagacattattgcaaatttttctgctatattgcaatttatgcgtttgtaaaaactcccatgttctgcagcattgcattctaaaaatagtggaactgatgagaaaagtaatttcattgccatgtttcttactgagttgactttttgtgcatcctttaaactctgtatgatgataatagtaataataaattgaatttttttat

SEQ ID NO: 168865 - DNA, 738 bp, Homo sapiens
  Payload ID: 13244
  Gene Symbol: PRELID2
  Gene Name: PRELI domain containing 2
  Uniprot ID: Q8N945
  ENST ID: ENST00000505416
  CDS Start-End: 35-568
cgtggccggtgcgcggggcccgcggcgcgcggggatgggggtctcggtggatgtgcaccaggtgtacaagtaccccttcgagcaggtggtcgccagctttctccgaaagtaccccaaccccatggataaaaatgtcatctcagtaaaaatcatggaggaaaaaagagatgaatcaacaggggtcatctacagaaagaggattgcaatctgtcagaacgtggttccagaaattttaaggaaggtgagcattttgaaagtacctaatatccaattagaagaggagtcatggctcaatcctcgggaaagaaacatggccatacggagtcactgccttacgtggacacagtatgcatccatgaaggaagagtctgtcttccgggaaagtatggaaaacccaaattggacagagttcattcaaagaggcaggatttcaatcacaggggttggatttctcaactgtgttttagaaacttttgccagcacattcttacgacagggagcccagaagggaattagaatcatggagatgctgctaaaggaacagtgtggtgcccccttagctgaataaagaatcatcaaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataa

SEQ ID NO: 168866 - DNA, 1715 bp, Homo sapiens
  Payload ID: 13245
  Gene Symbol: PRELID3A
  Gene Name: PRELI domain containing 3A
  Uniprot ID: Q96N28
  ENST ID: ENST00000336990
  CDS Start-End: 81-599
cccgcccacgccgcgcccggagccgcgcggcccgaagcacccggcccggatcgcagagcccgcgccctgcgccggcggcaatgaagatctggagctcggagcacgtgtttggccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatgatgcttcccagaagaaaggaaagaaggaggtgaggagaggacgagcaaggacgggacggaaaagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggccctcgcccgtgtcccttaggggcggcgcccatcgtcctgcctgccgcagtggcccagccccttctctccctgcaggtgacccgcgccgcccccgcccgcccgcccacgctgtcctccacttaggctcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctggat

SEQ ID NO: 168867 - DNA, 1716 bp, Homo sapiens
  Payload ID: 13245
  Gene Symbol: PRELID3A
  Gene Name: PRELI domain containing 3A
  Uniprot ID: Q96N28
  ENST ID: ENST00000440960
  CDS Start-End: 81-599
cccgcccacgccgcgcccggagccgcgcggcccgaagcacccggcccggatcgcagagcccgcgccctgcgccggcggcaatgaagatctggagctcggagcacgtgtttggccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatggtgatgcttcccagaagaaaggaaagaaggaggtgaggagaggacgagcaaggacgggacggaaaagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggccctcgcccgtgtcccttaggggcggcgcccatcgtcctgcctgccgcagtggcccagccccttctctccctgcaggtgacccgcgccgcccccgcccgcccgcccacgctgtcctccacttaggctcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctgg

SEQ ID NO: 168868 - DNA, 1694 bp, Homo sapiens
  Payload ID: 13245
  Gene Symbol: PRELID3A
  Gene Name: PRELI domain containing 3A
  ENST ID: ENST00000587735
  CDS Start-End: 324-572
cgcagcctgttttattttgccgggagcatagtgctgctgcacgctccactctgttggaattcatttctttgctcagtggctcacctgctggagcggaagcgccctggacacaggggttttgtctctgtcccttgctgcatcccatgatatcatttcttgaatagtgaactaattagtaaatgcaatggtattcggtggtgatatgaagtagaatttttaacgttccactatgctagttttgctttgttttctagattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatggtgatgcttcccagaagaaaggaaagaaggaggtgaggagaggacgagcaaggacgggacggaaaagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggccctcgcccgtgtcccttaggggcggcgcccatcgtcctgcctgccgcagtggcccagccccttctctccctgcaggtgacccgcgccgcccccgcccgcccgcccacgctgtcctccacttaggctcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctggataaa

SEQ ID NO: 168869 - DNA, 580 bp, Homo sapiens
  Payload ID: 13245
  Gene Symbol: PRELID3A
  Gene Name: PRELI domain containing 3A
  ENST ID: ENST00000587862
  CDS Start-End: 38-580
acttgagcctgggaggtttgagtctgcagtgaccctgatggcaccactgcattcctgcctgctgggcgacagagtgagaccctgtctcagacaaacaaaaaccaaggggctgccaggtgccgaggcgtgcagccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatc

SEQ ID NO: 168870 - DNA, 2001 bp, Homo sapiens
  Payload ID: 13245
  Gene Symbol: PRELID3A
  Gene Name: PRELI domain containing 3A
  Uniprot ID: Q96N28
  ENST ID: ENST00000592149
  CDS Start-End: 424-879
aaaaaagtcattcaggtttggtggcacacgcctgtagtcccagctactggaggtggggcaagaggaggctgaggcaggatgttcacttgagcctgggaggtttgagtctgcagtgaccctgatggcaccactgcattcctgcctgctgggcgacagagtgagaccctgtctcagacaaacaaaaaccaaggggctgccaggtgccgaggcgtgcaggtgctgagccggcggccggggagggctcgcgggactcctcagatttgtcggaccagcctttcattaaagtgaagagactagcgcgttgcccaggcctggcggcggcttttcctccccttcacccttgcggccccggccccggcgcttgctcaccgccgcctatgctctccccgcagccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatggtgatgcttcccagaagaaaggaaagaaggaggtgaggagaggacgagcaaggacgggacggaaaagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggccctcgcccgtgtcccttaggggcggcgcccatcgtcctgcctgccgcagtggcccagccccttctctccctgcaggtgacccgcgccgcccccgcccgcccgcccacgctgtcctccacttaggctcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctggataaa

SEQ ID NO: 168871 - DNA, 777 bp, Homo sapiens
  Payload ID: 13245
  Gene Symbol: PRELID3A
  Gene Name: PRELI domain containing 3A
  ENST ID: ENST00000590956
  CDS Start-End: 182-430
cccgcccacgccgcgcccggagccgcgcggcccgaagcacccggcccggatcgcagagcccgcgccctgcgccggcggcaatgaagatctggagctcggagcacgtgtttggattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatggtgatgcttcccagaagaaaggaaagaaggaggtgaggagaggacgagcaaggacgggacggaaaagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggccctcgcccgtgtcccttaggggcggcgcccatcgtcctgcctgccgcagtggcccagccccttctctccctgcaggtgaccc

SEQ ID NO: 168872 - DNA, 777 bp, Homo sapiens
  Payload ID: 13245
  Gene Symbol: PRELID3A
  Gene Name: PRELI domain containing 3A
  ENST ID: ENST00000589565
  CDS Start-End: 130-273
gcagagcccgcgccctgcgccggcggcaatgaagatctggagctcggagcacgtgtttggattttgggaaccagtaggacattgacatacatccgagaacattctgtggtggatccagtggaaaagaaaatggaactttgttctaccaatgctggagtgcagtggatctcagcaccctgcaacctccacttcatgggttcaagcgattctcctgtctcaccctcccaagtagctgggactacagatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatgatgcttcccagaagaaaggaaagaaggaggtgaggagaggacgagcaaggacgggacggaaaagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggccctcgcccgtgtcccttaggggcggcgcccatcgtcctgcctg

SEQ ID NO: 168873 - DNA, 488 bp, Homo sapiens
  Payload ID: 13245
  Gene Symbol: PRELID3A
  Gene Name: PRELI domain containing 3A
  ENST ID: ENST00000589952
  CDS Start-End: 88-488
gcactccggcctgggtgacagagcaagactccgtctcaaacaaaaaagtcattcagccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaa

SEQ ID NO: 168874 - DNA, 529 bp, Homo sapiens
  Payload ID: 13245
  Gene Symbol: PRELID3A
  Gene Name: PRELI domain containing 3A
  ENST ID: ENST00000588729
  CDS Start-End: 32-529
atcgcagagcccgcgccctgcgccggcggcaatgaagatctggagctcggagcacgtgtttgggcagaatcttgctctatcacccaggctggagtgcagtggcacgatcttggctcaccacaacctctgcctctccggttcaagcaattcttgtgcttcagcctcccgagtagctgggaccacaggcgtgtgccaccacgcctgccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaaccca

SEQ ID NO: 168875 - DNA, 2626 bp, Homo sapiens
  Payload ID: 13246
  Gene Symbol: PRELID3B
  Gene Name: PRELI domain containing 3B
  Uniprot ID: Q9Y3B1
  ENST ID: ENST00000355937
  CDS Start-End: 180-764
aaaacccgggccgggatagggcgtggggccgcgcgtctggacgtccctcgcgtcgggcccgacagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagtttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaagtga

SEQ ID NO: 168876 - DNA, 943 bp, Homo sapiens
  Payload ID: 13246
  Gene Symbol: PRELID3B
  Gene Name: PRELI domain containing 3B
  Uniprot ID: Q9Y3B1
  ENST ID: ENST00000371033
  CDS Start-End: 76-570
gggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagtttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcc

SEQ ID NO: 168877 - DNA, 704 bp, Homo sapiens
  Payload ID: 13246
  Gene Symbol: PRELID3B
  Gene Name: PRELI domain containing 3B
  ENST ID: ENST00000463057
  CDS Start-End: 3-209
ccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctttctgaatgttttacttagcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagt

SEQ ID NO: 168878 - DNA, 3941 bp, Homo sapiens
  Payload ID: 13247
  Gene Symbol: POF1B
  Gene Name: premature ovarian failure, 1B
  Uniprot ID: Q8WVV4
  ENST ID: ENST00000262753
  CDS Start-End: 147-1916
accatttcctggagcaatgtcacagggtggctccattttccatttgagctcaaatattttgctgcttcctctgtagctgccagacctgctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctctcccctctcaaaaccacctcctcctaccaaaatttggtttggagcgaccattctcaggaactccattctccaactttaaaaatatctacatgtgccccaagtactctacatataacccaaaatactgaacaggaacttcattctccaacagtgaaacttactacatatccacagaccactattaggaaatatgtagtacaaaatcctgaacaggaaccactgtctcaattcctaagaggaagccatttcttcccaggaaacaatgttatttatgaaaaaacaataagaaaagtggagaagctaaatactgatcaggggtgccatcctcaggctcaatgccatcatcacattatccaacagccccaggtcatccactctgcacactggcaacaacctgattctagccagcaaatccaagccatcacaggaaataatccaatttctacacatattggaaatgaactgtgccatagtggatcaagccagatttgtgagcaggtgataattcaggatgatggccctgaaaaattggaccccagatattttggagagttgcttgctgatctgagccgtaagaatacggatctatatcactgcttattagaacatttgcagagaattggaggaagcaaacaggactttgagtctacagatgagtcggaagacattgaatcattgattcctaaaggattatcagagtttacaaaacagcaaatacgctacattctgcagatgaggggtatgtctgataagtcactccgactagtgctgtccacatttagcaacatacgggaggagcttggacatcttcaaaatgatatgacatcactggaaaatgacaagatgagacttgagaaagatttatcattcaaagacactcaattaaaagagtacgaagaactcttggcatcagtgagagcaaataatcaccagcagcagcaaggacttcaagactcaagttcaaaatgccaggcattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtccatgaatggatccactttaaagtattacaactcaaagccgttttttttttgtgtgtgtgtctctgcattagtactttgttatttttccatcactaaaggccaatcagaatttggaaccatgctgctacccaagaaatctaatggaatgaattagttctgtagatgacaatttcttcacccatttatgagacctaaatcttttccataacactcatgtattcagtataacaacatactaactgaaagagggacctgattgtttaaagtttgattgcagacactgtagaacataactcattatgtttcagataaggtaactcctagatatcaaactaatttgttggggtagagattttacaagtcatgccattagaagattttctctgatattatatgtgcagttcagttacaagatgaaatcatgtttttttaacaaaagagataaaatacaattgaagcaaaaaataacagctagtatataatatatacagtctgtatttgcttttcacagtaggcctgatgactaaaagatatgctttattacacgctattttcacctcttgaaagtcaaaggtgatgattaatttcatttagcagggaagtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtaaggaaggtaagttttttcatagtggtatgcaaacatatcattgaaatattacatagatataaagacttagggaataaaaatagcagcaacaaatacttgatagatttatcctacttgggagaaatattttgtagcagagtatttagtatacttagaagttgatttagcaattaggctttaatgaccttacaaagtgaacataactgaacacaagtattttttcaatgcaagatgaggatgaaaattttacatttcaacccatctggctaaagttaagacttagcaaaaattaaaatgttgcctttgtccaagtatagattaaggcaacaaacatatttgggtgtgtaatttgaagttttggactgaaatatctttgcaagtatccacataaaattctgtaatgccttataattatattctaataattatgcattatactaagacaccattaagaacagttgaggcactacactaaatcaaaccataaatgaggaaaaaacttttaatgttcttttctagaagtgttcaaataggtcttgatatgaagctaaaagccttatttatattatcttaatatttcggctaaaatgttaagctccataacatgaattgatacaattccaattttatcaatattttgtgatagaaaaatgttaatattattcatgagctatacagtccttacattttttcccttggtgtaggaacaacggaggagtttctcctctgctaactattcatatatgtaactgtaacaaaagtgtactatgttatgcacacattacaaataatataaggggaagttttattagcttagtaggaaattgttattattaaggtttaaaaatgagaacaggtgtgagttttccaaaatacttaaaaataatagtgtcaaaaattcaggggcagttaaggagtcatggatggaactagaggtcactatattaagtgacataagccagaaacagacaaacattgcatgttctcaattatttgcgggatctaaaagtcaaaacaattgaactcatggatatagagagtagaaggatggttactagtggctgggaaaaggggtgtgcgaggggaactggggatgcttaatgtgtacaaaaactatgtagttagaaagtataaataagacctagtatttgatagcacaaccgggtgagtatagtcaataatagcttaattgtacaaataactaagagtataattggattgtttgtaacacaaataaatacttgagtggatggata

SEQ ID NO: 168879 - DNA, 1972 bp, Homo sapiens
  Payload ID: 13247
  Gene Symbol: POF1B
  Gene Name: premature ovarian failure, 1B
  Uniprot ID: Q8WVV4
  ENST ID: ENST00000373145
  CDS Start-End: 121-1908
gtggctccattttccatttgagctcaaatattttgctgcttcctctgtagctgccagacctgctcttgctgctgctcaggtagaacatctgggaggtcccttgctgaccactggaagaagatgagctcgagctattggagtgagacgagcagcagcagctgtggaacccagcagctcccagaggtgctgcagtgccagccccagcattaccactgctaccatcagtcaagccaagcccagcagcctccagaaaaaaatgtagtgtatgagcgagtgaggacctacagtgggcccatgaacaaggtggtgcaggccttggaccccttcaactcacgggaagtgctctcccctctcaaaaccacctcctcctaccaaaatttggtttggagcgaccattctcaggaactccattctccaactttaaaaatatctacatgtgccccaagtactctacatataacccaaaatactgaacaggaacttcattctccaacagtgaaacttactacatatccacagaccactattaggaaatatgtagtacaaaatcctgaacaggaaccactgtctcaattcctaagaggaagccatttcttcccaggaaacaatgttatttatgaaaaaacaataagaaaagtggagaagctaaatactgatcaggggtgccatcctcaggctcaatgccatcatcacattatccaacagccccaggtcatccactctgcacactggcaacaacctgattctagccagcaaatccaagccatcacaggaaataatccaatttctacacatattggaaatgaactgtgccatagtggatcaagccagatttgtgagcaggtgataattcaggatgatggccctgaaaaattggaccccagatattttggagagttgcttgctgatctgagccgtaagaatacggatctatatcactgcttattagaacatttgcagagaattggaggaagcaaacaggactttgagtctacagatgagtcggaagacattgaatcattgattcctaaaggattatcagagtttacaaaacagcaaatacgctacattctgcagatgaggggtatgtctgataagtcactccgactagtgctgtccacatttagcaacatacgggaggagcttggacatcttcaaaatgatatgacatcactggaaaatgacaagatgagacttgagaaagatttatcattcaaagacactcaattaaaagagtacgaagaactcttggcatcagtgagagcaaataatcaccagcagcagcaaggacttcaagactcaagttcaaaatgccaggcattggaagaaaacaatctctctcttcgacatacactatcagacatggaatacagactaaaagaactggaatattgtaaacgtaatttagagcaagagaatcaaaaccttagaatgcaggtttctgagacttgcacaggcccaatgttgcaggctaaaatggatgagattggcaaccactacacggagatggtaaaaaacttgagaatggagaaagatagagagatctgcagactgaggtcccaattaaaccagtaccataaagatgtttcaaagagagaaggaagttgtagtgacttccaatttaagcttcatgaactgacaagcttgctggaagagaaggattccctcataaagcgtcagtcagaggaactctccaagttgcggcaagaaatatattcctctcataaccaaccctccactggtggaaggactactattaccactaaaaagtacaggacacaatatccaatcctaggcctcctatatgatgactacgaatatataccaccaggtagtgaaacacagactattgtgattgagaaaacagaagacaaatacacttgtgtaagttcacttgggcatttttagccctattttgacgatatatgtacagccttttaaaattgaggtaaaatatcaaatgaactaaaaa

SEQ ID NO: 168880 - DNA, 2127 bp, Homo sapiens
  Payload ID: 13248
  Gene Symbol: PMEL
  Gene Name: premelanosome protein
  Uniprot ID: P40967
  ENST ID: ENST00000449260
  CDS Start-End: 12-2018
ggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 168881 - DNA, 568 bp, Homo sapiens
  Payload ID: 13248
  Gene Symbol: PMEL
  Gene Name: premelanosome protein
  ENST ID: ENST00000549418
  CDS Start-End: 116-568
aagtttggttcttgggggctagacaagtttcttccccggtggggcggctgaacactcttcccaagggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttat

SEQ ID NO: 168882 - DNA, 912 bp, Homo sapiens
  Payload ID: 13248
  Gene Symbol: PMEL
  Gene Name: premelanosome protein
  ENST ID: ENST00000546543
  CDS Start-End: 16-912
ggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaacc

SEQ ID NO: 168883 - DNA, 2204 bp, Homo sapiens
  Payload ID: 13248
  Gene Symbol: PMEL
  Gene Name: premelanosome protein
  Uniprot ID: P40967
  ENST ID: ENST00000548493
  CDS Start-End: 111-2096
tcaacgtcagagccggggggcgagcccagcgctcctccccgcaaatgatcccgccccaggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 168884 - DNA, 895 bp, Homo sapiens
  Payload ID: 13248
  Gene Symbol: PMEL
  Gene Name: premelanosome protein
  ENST ID: ENST00000548803
  CDS Start-End: 8-895
gaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 168885 - DNA, 901 bp, Homo sapiens
  Payload ID: 13248
  Gene Symbol: PMEL
  Gene Name: premelanosome protein
  ENST ID: ENST00000550447
  CDS Start-End: 15-887
gagggaagaacacaatggatctggtgctaaaaagatgccttcttcatttggctgtgataggtgctttgctggctgtgggggctacaaaaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatga

SEQ ID NO: 168886 - DNA, 2757 bp, Homo sapiens
  Payload ID: 13248
  Gene Symbol: PMEL
  Gene Name: premelanosome protein
  Uniprot ID: P40967
  ENST ID: ENST00000548747
  CDS Start-End: 664-2649
agtttggttcttgggggctagacaagtttcttccccggtggggcggctgaacactcttcccaagtacctgctttgggtccaagtttcctacctatgtctctagtctgtagggatttcttgatttctaactcactattttcaccaatcctggggaaaatatgtatcgacctaaggttaaattccacctggcccaggagcctcctttggaaaccaggaagccgggaatctcgttgcaaaggaatcctgggcctcagaggagtcgttgcctctgcctcatagcataccccgacactgtctctgttttgggatgcagggttctgtttctgtctttttgagaagttcctggtttaattcactctcccatgataaactgttgtgtctggtatgtgttacgcagctgcctttcagttagctcttgcccgggagtgcatcaagatgagagtgacccagtgaaaccagaaactgtcattgagtagcaggatgggaaagcaatgtctagggaccaggatccctttgtcagtttttcctttttcctctcctccggcccctcccaggccttctctgagggagaagaggaagggctatgcaaatgagcacccttttcttatataggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 168887 - DNA, 1047 bp, Homo sapiens
  Payload ID: 13248
  Gene Symbol: PMEL
  Gene Name: premelanosome protein
  ENST ID: ENST00000547137
  CDS Start-End: 16-1047
ggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctaca

SEQ ID NO: 168888 - DNA, 573 bp, Homo sapiens
  Payload ID: 13248
  Gene Symbol: PMEL
  Gene Name: premelanosome protein
  ENST ID: ENST00000549233
  CDS Start-End: 170-573
ggaaaacttttctgtctgtgatatgaaacagaaaggaaaaacggcgggcttactgggaaatgcagtgtcgaaagagttggctggccaagactagaagagtccgaaagatccggaagagctggtcaatctcagaatctccagggaatagggcccggcgagtcacctgaaaatggggaaagaggaaataccaagacccacgttgacgtcagtcaaaactctcctctatacaaaggagttcccacagacagtaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatctt

SEQ ID NO: 168889 - DNA, 1355 bp, Homo sapiens
  Payload ID: 13248
  Gene Symbol: PMEL
  Gene Name: premelanosome protein
  ENST ID: ENST00000549404
  CDS Start-End: 1-1355
ccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcg

SEQ ID NO: 168890 - DNA, 2516 bp, Homo sapiens
  Payload ID: 13248
  Gene Symbol: PMEL
  Gene Name: premelanosome protein
  Uniprot ID: P40967
  ENST ID: ENST00000552882
  CDS Start-End: 422-2407
gggggctagacaagtttcttccccggtggggcggctgaacactcttcccaagtacctgctttgggtccaagtttcctacctatgtctctagtctgtagggatttcttgatttctaactcactattttcaccaatcctggggaaaatatgtatcgacctaaggttaaattccacctggcccaggagcctcctttggaaaccaggaagccgggaatctcgttgcaaaggaatcctgggcctcagaggagtcgttgcctctgcctcatagcataccccgacactgtctctgttttgggatgcagggttctgtttctgtctttttgagaagttcctggtttaattcactctcccatgataaactgttgtgtctggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 168891 - DNA, 1867 bp, Homo sapiens
  Payload ID: 13248
  Gene Symbol: PMEL
  Gene Name: premelanosome protein
  Uniprot ID: P40967
  ENST ID: ENST00000550464
  CDS Start-End: 32-1759
agtgcctttggttgctggagggaagaacacaatggatctggtgctaaaaagatgccttcttcatttggctgtgataggtgctttgctggctgtgggggctacaaaagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 168892 - DNA, 788 bp, Homo sapiens
  Payload ID: 13249
  Gene Symbol: PRPF18
  Gene Name: pre-mRNA processing factor 18
  ENST ID: ENST00000320054
  CDS Start-End: 286-788
tgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtgaggaactcgattgaggaccagaggtccagtcacaagtaacaagccactagccaggtgcttcaggaagaccgccctcttgcctctgtggaatccagtgaggatgatcagaacgttccccggggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataa

SEQ ID NO: 168893 - DNA, 1717 bp, Homo sapiens
  Payload ID: 13249
  Gene Symbol: PRPF18
  Gene Name: pre-mRNA processing factor 18
  Uniprot ID: Q99633
  ENST ID: ENST00000378572
  CDS Start-End: 161-1189
ctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaagacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggta

SEQ ID NO: 168894 - DNA, 1062 bp, Homo sapiens
  Payload ID: 13249
  Gene Symbol: PRPF18
  Gene Name: pre-mRNA processing factor 18
  ENST ID: ENST00000417658
  CDS Start-End: 315-1062
agcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtgaggaactcgattgaggaccagaggtccagtcacaagtaacaagccactagccaggtgcttcaggaagaccgccctcttgcctctgtggaatccagtgaggatgatcagaacgttccccggggaaaataaaaaatatttcaagcgtagtgagctcgccaaaaaagaagaggaagcatattttgaaagatgtggctacaagcctataaatgagaagccatctggagagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaagacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaat

SEQ ID NO: 168895 - DNA, 2157 bp, Homo sapiens
  Payload ID: 13250
  Gene Symbol: PRPF19
  Gene Name: pre-mRNA processing factor 19
  Uniprot ID: Q9UMS4
  ENST ID: ENST00000227524
  CDS Start-End: 207-1721
ggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggtggggcggataaaaatgtcgttgtgtttgacaaaagttctgaacaaatcctggctaccctcaaaggccataccaagaaggtcaccagcgtggtgtttcacccttcccaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcagtactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttgggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataa

SEQ ID NO: 168896 - DNA, 943 bp, Homo sapiens
  Payload ID: 13250
  Gene Symbol: PRPF19
  Gene Name: pre-mRNA processing factor 19
  ENST ID: ENST00000541371
  CDS Start-End: 188-943
tgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaagagagggaagactgtgcctgaggagctggtgaagccagaagagctcagcaaataccggcaggtggcatcccacgtggggttgcacagtgccagcattcctgggatcctggccctggacctctgcccgtccgacaccaacaagatcctcactggaaccatggactctcagatcaagatctgggacttgaag

SEQ ID NO: 168897 - DNA, 169 bp, Homo sapiens
  Payload ID: 13250
  Gene Symbol: PRPF19
  Gene Name: pre-mRNA processing factor 19
  ENST ID: ENST00000540473
  CDS Start-End: 1-138
attattcagaagcttcaagacaaagccactgtgctaaccacggagcgcaagaagagagggaagactgtgcctgaggagctggtgaagccagaagagctcagcaaataccggcaggagggcttgtgcagggttttgtaagcagtgatctagtttcattaaaaaaagaaaa

SEQ ID NO: 168898 - DNA, 779 bp, Homo sapiens
  Payload ID: 13250
  Gene Symbol: PRPF19
  Gene Name: pre-mRNA processing factor 19
  ENST ID: ENST00000535326
  CDS Start-End: 1-360
tactgggctttctctgacatccagacagggcgtgtgctcaccaaggtgacagatgagacctccggctgctctctcacctgtgcacagttccaccctgacggactcatctttggaacaggaaccatggactctcagatcaagatctgggacttgaaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttgggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcatta

SEQ ID NO: 168899 - DNA, 814 bp, Homo sapiens
  Payload ID: 13250
  Gene Symbol: PRPF19
  Gene Name: pre-mRNA processing factor 19
  ENST ID: ENST00000546152
  CDS Start-End: 503-814
ttcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccaaacctgtacattgatccaaagagggggaagaaggaagggaaatgatggaaaaggaatccctcactttgaagaaattacagctcgcaaatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctaccctgaaaccacaggctggcctcattgtgccccaggctgtgccaagttcccaaccaagtgttgtgggtgcgggtgagccaatggatttgggtgagctggtgggaatgaccccagagattattcagaagcttcaagacaaagccactgtgctaaccacggagcgcaagaag

SEQ ID NO: 168900 - DNA, 2433 bp, Homo sapiens
  Payload ID: 13251
  Gene Symbol: PRPF3
  Gene Name: pre-mRNA processing factor 3
  Uniprot ID: O43395
  ENST ID: ENST00000324862
  CDS Start-End: 166-2217
ggagacagcggcgtggcggcggcggtggcggtagcgacggcacgccgtagggcggtcagaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 168901 - DNA, 2126 bp, Homo sapiens
  Payload ID: 13252
  Gene Symbol: PRPF31
  Gene Name: pre-mRNA processing factor 31
  Uniprot ID: Q8WWY3
  ENST ID: ENST00000321030
  CDS Start-End: 350-1849
cgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccctttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtc

SEQ ID NO: 168902 - DNA, 1767 bp, Homo sapiens
  Payload ID: 13252
  Gene Symbol: PRPF31
  Gene Name: pre-mRNA processing factor 31
  ENST ID: ENST00000391755
  CDS Start-End: 9-1490
gcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtc

SEQ ID NO: 168903 - DNA, 854 bp, Homo sapiens
  Payload ID: 13252
  Gene Symbol: PRPF31
  Gene Name: pre-mRNA processing factor 31
  ENST ID: ENST00000447810
  CDS Start-End: 73-854
ggggaccacggggagcgggaggctgggctcctgggtctgggagaagaagtgtgtgaggaaaaaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcggg

SEQ ID NO: 168904 - DNA, 928 bp, Homo sapiens
  Payload ID: 13252
  Gene Symbol: PRPF31
  Gene Name: pre-mRNA processing factor 31
  ENST ID: ENST00000445811
  CDS Start-End: 76-928
ggtgagcgactaacgctagaaacagtggtgcgcggagaggagagggaacgctgctgtccctccccaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccac

SEQ ID NO: 168905 - DNA, 2269 bp, Homo sapiens
  Payload ID: 13252
  Gene Symbol: PRPF31
  Gene Name: pre-mRNA processing factor 31
  Uniprot ID: Q8WWY3
  ENST ID: ENST00000419967
  CDS Start-End: 397-1872
tagtttcctgtttccggcttcgcttcggcccacccccacgtccaccccgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccctttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcaggtatgggccagacccaggtggggctggggaccgagggacacaaggtggggggagcccagatcgcagcctccctgtcctccccacagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaagatctgtc

SEQ ID NO: 168906 - DNA, 886 bp, Homo sapiens
  Payload ID: 13252
  Gene Symbol: PRPF31
  Gene Name: pre-mRNA processing factor 31
  ENST ID: ENST00000445124
  CDS Start-End: 58-886
tggtgcgcggagaggagagtttttagggaacgctgctgtccctccccaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccaca

SEQ ID NO: 168907 - DNA, 2269 bp, Homo sapiens; identical to SEQ ID NO: 168905
  Payload ID: 13252
  Gene Symbol: PRPF31
  Gene Name: pre-mRNA processing factor 31
  ENST ID: ENST00000622636
  CDS Start-End: 397-1872

SEQ ID NO: 168908 - DNA, 886 bp, Homo sapiens; identical to SEQ ID NO: 168906
  Payload ID: 13252
  Gene Symbol: PRPF31
  Gene Name: pre-mRNA processing factor 31
  ENST ID: ENST00000613020
  CDS Start-End: 58-886

SEQ ID NO: 168909 - DNA, 851 bp, Homo sapiens
  Payload ID: 13252
  Gene Symbol: PRPF31
  Gene Name: pre-mRNA processing factor 31
  ENST ID: ENST00000622164
  CDS Start-End: 70-851
gaccacggggagcgggaggctgggctcctgggtctgggagaagaagtgtgtgaggaaaaaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcggg

SEQ ID NO: 168910 - DNA, 2269 bp, Homo sapiens; identical to SEQ ID NO: 168905
  Payload ID: 13252
  Gene Symbol: PRPF31
  Gene Name: pre-mRNA processing factor 31
  Uniprot ID: Q8WWY3
  ENST ID: ENST00000612749
  CDS Start-End: 397-1872

SEQ ID NO: 168911 - DNA, 1767 bp, Homo sapiens; identical to SEQ ID NO: 168902
  Payload ID: 13252
  Gene Symbol: PRPF31
  Gene Name: pre-mRNA processing factor 31
  ENST ID: ENST00000616532
  CDS Start-End: 9-1490

SEQ ID NO: 168912 - DNA, 2269 bp, Homo sapiens; identical to SEQ ID NO: 168905
  Payload ID: 13252
  Gene Symbol: PRPF31
  Gene Name: pre-mRNA processing factor 31
  ENST ID: ENST00000615175
  CDS Start-End: 397-1872

SEQ ID NO: 168913 - DNA, 2183 bp, Homo sapiens
  Payload ID: 13252
  Gene Symbol: PRPF31
  Gene Name: pre-mRNA processing factor 31
  ENST ID: ENST00000618937
  CDS Start-End: 397-1896
tagtttcctgtttccggcttcgcttcggcccacccccacgtccaccccgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccctttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaagatctgtc

SEQ ID NO: 168914 - DNA, 2269 bp, Homo sapiens; identical to SEQ ID NO: 168905
  Payload ID: 13252
  Gene Symbol: PRPF31
  Gene Name: pre-mRNA processing factor 31
  Uniprot ID: Q8WWY3
  ENST ID: ENST00000619391
  CDS Start-End: 397-1872

SEQ ID NO: 168915 - DNA, 2183 bp, Homo sapiens; identical to SEQ ID NO: 168913
  Payload ID: 13252
  Gene Symbol: PRPF31
  Gene Name: pre-mRNA processing factor 31
  ENST ID: ENST00000619439
  CDS Start-End: 397-1896

SEQ ID NO: 168916 - DNA, 2183 bp, Homo sapiens; identical to SEQ ID NO: 168913
  Payload ID: 13252
  Gene Symbol: PRPF31
  Gene Name: pre-mRNA processing factor 31
  ENST ID: ENST00000620861
  CDS Start-End: 397-1896

SEQ ID NO: 168917 - DNA, 2183 bp, Homo sapiens; identical to SEQ ID NO: 168913
  Payload ID: 13252
  Gene Symbol: PRPF31
  Gene Name: pre-mRNA processing factor 31
  ENST ID: ENST00000619956
  CDS Start-End: 397-1896

SEQ ID NO: 168918 - DNA, 2183 bp, Homo sapiens; identical to SEQ ID NO: 168913
  Payload ID: 13252
  Gene Symbol: PRPF31
  Gene Name: pre-mRNA processing factor 31
  ENST ID: ENST00000622300
  CDS Start-End: 397-1896

SEQ ID NO: 168919 - DNA, 2269 bp, Homo sapiens; identical to SEQ ID NO: 168905
  Payload ID: 13252
  Gene Symbol: PRPF31
  Gene Name: pre-mRNA processing factor 31
  Uniprot ID: Q8WWY3
  ENST ID: ENST00000621588
  CDS Start-End: 397-1872

SEQ ID NO: 168920 - DNA, 2183 bp, Homo sapiens; identical to SEQ ID NO: 168913
  Payload ID: 13252
  Gene Symbol: PRPF31
  Gene Name: pre-mRNA processing factor 31
  ENST ID: ENST00000620142
  CDS Start-End: 397-1896

SEQ ID NO: 168921 - DNA, 2269 bp, Homo sapiens; identical to SEQ ID NO: 168905
  Payload ID: 13252
  Gene Symbol: PRPF31
  Gene Name: pre-mRNA processing factor 31
  ENST ID: ENST00000618595
  CDS Start-End: 397-1872

SEQ ID NO: 168922 - DNA, 928 bp, Homo sapiens; identical to SEQ ID NO: 168904
  Payload ID: 13252
  Gene Symbol: PRPF31
  Gene Name: pre-mRNA processing factor 31
  ENST ID: ENST00000618333
  CDS Start-End: 76-928

SEQ ID NO: 168923 - DNA, 2126 bp, Homo sapiens; identical to SEQ ID NO: 168901
  Payload ID: 13252
  Gene Symbol: PRPF31
  Gene Name: pre-mRNA processing factor 31
  Uniprot ID: Q8WWY3
  ENST ID: ENST00000613693
  CDS Start-End: 350-1849

SEQ ID NO: 168924 - DNA, 2269 bp, Homo sapiens; identical to SEQ ID NO: 168905
  Payload ID: 13252
  Gene Symbol: PRPF31
  Gene Name: pre-mRNA processing factor 31
  ENST ID: ENST00000622387
  CDS Start-End: 397-1872

SEQ ID NO: 168925 - DNA, 2269 bp, Homo sapiens; identical to SEQ ID NO: 168905
  Payload ID: 13252
  Gene Symbol: PRPF31
  Gene Name: pre-mRNA processing factor 31
  ENST ID: ENST00000614518
  CDS Start-End: 397-1872

SEQ ID NO: 168926 - DNA, 2269 bp, Homo sapiens; identical to SEQ ID NO: 168905
  Payload ID: 13252
  Gene Symbol: PRPF31
  Gene Name: pre-mRNA processing factor 31
  ENST ID: ENST00000619220
  CDS Start-End: 397-1872

SEQ ID NO: 168927 - DNA, 2183 bp, Homo sapiens; identical to SEQ ID NO: 168913
  Payload ID: 13252
  Gene Symbol: PRPF31
  Gene Name: pre-mRNA processing factor 31
  Uniprot ID: Q8WWY3
  ENST ID: ENST00000610903
  CDS Start-End: 397-1896

SEQ ID NO: 168928 - DNA, 2183 bp, Homo sapiens; identical to SEQ ID NO: 168913
  Payload ID: 13252
  Gene Symbol: PRPF31
  Gene Name: pre-mRNA processing factor 31
  Uniprot ID: Q8WWY3
  ENST ID: ENST00000616732
  CDS Start-End: 397-1896

SEQ ID NO: 168929 - DNA, 5274 bp, Homo sapiens
  Payload ID: 13253
  Gene Symbol: PRPF38A
  Gene Name: pre-mRNA processing factor 38A
  Uniprot ID: Q8NAV1
  ENST ID: ENST00000257181
  CDS Start-End: 187-1125
attgattcgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatggggagtttgaattgatgcatgttgatgagtttattgatgaactattgcacagtgagagagtctgtgatatcattctgccccgactacagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatcttatttgagctttcatattcttcaatggttcctttcgtaatacctgagttaataaaagtggtctgaaagagctcttacggtttctgatagaactatataggactaccttttaagattaaatataagcatctgtacgtaaatgtattacagtgtcatagcagttatttctttatgaaagtgatctaggtagaaagaaatgtcttctggcatggacagaaatgacccatggaccaaccaagctgtcatccagtacactcttaaaataaaactttgtcttaaaatatgttttaaagtaaaaataaacccacgcacaaagcccaataaattttagtaacagaaataaacctccctaaacaaacattaaaacatacttgtttagacatatggtaatatgtggaccaaaattgaggtaccacagccaatcaatagcaggaaagagaatgtccctattctttaattagaagaaggaggtaagagtaagacatgttgcatgtctgtagatatcgttttgataaaattacacaggagatggagcttgaggacaaaccttgctgtaaggctctttctgtcatctatgtgcttgcctatggatgaagcattttaaactttttgactacagcatacattttaaaaacgtattttacatcttacctctgtacacatctgtattctgtactgagacaaatttcaggaaagaatacttactatgcaaagtgaattctggtgtttcctacttgttaacagtttttaatattggatgaaaccacttaatcgatttcacttccaataatttgaaatacactgacttaaaagctttgccatagggcacaatcgccttttaatactaagaaagtaagggagatgtgttccaaggggcaaaagaaataatgcatttttggccaggtgcggtggctcacgcctgtaatcccagcactttgggaggccgaggcgggcagatcacctgaggtcgggagtttgagaccagcctggccaacatggagaaaccctgtctctactaaaaaatacaaaattagccgggcatggtggcgcatgcctgtaatcccagttacttgggaggctgaggcaggagaatcgcttgaacctgggaggcagaggatgcggtgagctgagatcgtgccactgcacttcagcctgggcaaaaagagcgaaactccatctcaaaaaaaaaaaaaaaagaagaagaagaatgggtttggtgagagggttccaatattaacaacccaacttcaagctcattcctctaacctcttcctgtttgttattcttcagtagaccgaagtttaaataagcattatttagaaaagaacgatcacagattgcccactccctcaaaaaggttaatgtgacagaaattctccacctgctcaaaaaagacagcagacatgatctctttaaaaaaaaaaagttcaaaagagattaagagatgaaaaataagattggtggagtttaaaggccttatactagaaaccacaaaacataaaacagcacagagaaaataggctggaggaaataaaaaatggaaaagagaaatatgtagaataaagaaatattctgatggtttaaaaagaattggccgggtgcggtggctcacgcctgtaatcccagcactttgggaggccgaggcagacggatcatgaggtcaggagatcgagaccatccaggctaacacagtgaaacccgtctctactaaaaatacaaaaaattagctgggtgtgctggcgggtagagctactagggaggctgaggcaggagaatggcgtgaatccgggaggcggagctttcagtgagccgagatcgcgccattgcactccagcctgggcaacagagtgagactccgtctcaaaaagaaaaaagaattaaatggggtcaggatggtctcagatcttataacaagaaggcaatgaagcaaaaggctccaaaggtttgagaaaaagtgccaggaattttatactttgccaaagttgtcttaaaatacaaaggctatagatgttctcaagtttgtaagaacttaaaagtacaaatcatgagtctttgggaaaaaaccgcccaataatgaaattcaactaaagaagaaatgaatcaaattaaggacttaggaacaaagaatcagtaaaaggagtgttagtaaacacttcagaaactttaaaaataatgggcaatgattataaagtcaaatattatgaacactgtctatatagaaataacaagtagagtgtgctggtttcatctttcatagcaggaatcacgtacagtctctaattaaaacatacatgaagctagaaaaaaaaatagcctctttattgttttccgtaattgtccttaattttaggagaaatcttacaagactagattctcttgtggggaaaaaagtatttaaattgagcattttttcagtttcacacttgttttccttttgttaatttgctatatttgttaaatatagcatatgagcccacttttgtaaaactatttgtatatatgtgcctgtatgattaagagagatggttggaatgaatgaagttcaccagatagtacttctttctggctgatgaacttttgaatgatttttaaactttgtacttttatataatgcttattttctttttacaataaacatgttaatttctacaaggaagaaatga

SEQ ID NO: 168930 - DNA, 3728 bp, Homo sapiens
  Payload ID: 13254
  Gene Symbol: PRPF38B
  Gene Name: pre-mRNA processing factor 38B
  ENST ID: ENST00000370021
  CDS Start-End: 638-1945
atcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggattgactcagtcttgcagcgaggctcggagcagcccagggtcgcaggtagaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaataatctttattagaatacttgataatggcagttccctttgtcagtggttgttacatgtgtcatttgattactttgttccatgtcaaagacgtttattgggataccttttacttggacaatatgttagcattttttaaaatttggacttgaaattctttaagataattcacccaattctttttagaaaagaaaatagaggcccaaagtaatgatgtcagtgctagggctaaaactcagtattctgacagtgtagtgaacctggcacgcacattgaggtttgttttatctcactggttatactggccaactaatgcgcactcagaagccaccttgcaaaaatgttaaatggagcaaacgagtacacttgcaagagtcctccatatgtgggcttaacatatgtaccactccattttagaaaaatctcattaaatgaattcttctaaaaa

SEQ ID NO: 168931 - DNA, 1591 bp, Homo sapiens
  Payload ID: 13254
  Gene Symbol: PRPF38B
  Gene Name: pre-mRNA processing factor 38B
  Uniprot ID: Q5VTL8
  ENST ID: ENST00000370022
  CDS Start-End: 269-841
ggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagagttcttcaccctctagcttcttccaaatatcagtattcccacttgcatagaagtgcagaattgaagagttgggtgttacataaataggctaagtgtttggatgacttgttcaaggtgacaaaattttaattccagttttctgactcctagtacaccacacacacctttaaaaaagaaattttttaaattgtaattcgagtctccctaatttgaaatctgaaatactaagttagatttaaatcgtgtatgcattggctgggcgtggtggctcacattgtaatcccaacacttcgagagttcaagaccagcctgagcaatatagtgagacctcatctctacaaaaaaaagtttaaaaattagctgagcatagaggtatgcatcttagtcccacctacttgggaggctggggtgggaggatcacttgagcccaggagacagaatttgctgtgagccaagatcattgccactgcattccagcctgggtaacacagtaagaccctttctcaaaacaaaacaaaatatcatatatgcattaatttacttgcatggtgaagtccaacatgtcaaaaatgaaatgatgagctgtattgtccctatgtctacccagtctactactttgtgttttaaggttcataagactttttgagtgctatgtgtcagtagtctatttacagagttcatccaaagaatttattgaattaaaggatggttctaatggaaatctattgtgttttgttattacatgcacacctaaaaaaaaaaaaaa

SEQ ID NO: 168932 - DNA, 3693 bp, Homo sapiens
  Payload ID: 13254
  Gene Symbol: PRPF38B
  Gene Name: pre-mRNA processing factor 38B
  Uniprot ID: Q5VTL8
  ENST ID: ENST00000370025
  CDS Start-End: 270-1910
gggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaataatctttattagaatacttgataatggcagttccctttgtcagtggttgttacatgtgtcatttgattactttgttccatgtcaaagacgtttattgggataccttttacttggacaatatgttagcattttttaaaatttggacttgaaattctttaagataattcacccaattctttttagaaaagaaaatagaggcccaaagtaatgatgtcagtgctagggctaaaactcagtattctgacagtgtagtgaacctggcacgcacattgaggtttgttttatctcactggttatactggccaactaatgcgcactcagaagccaccttgcaaaaatgttaaatggagcaaacgagtacacttgcaagagtcctccatatgtgggcttaacatatgtaccactccattttagaaaaatctcattaaatgaattcttctaaaaa

SEQ ID NO: 168933 - DNA, 2868 bp, Homo sapiens
  Payload ID: 13255
  Gene Symbol: PRPF39
  Gene Name: pre-mRNA processing factor 39
  Uniprot ID: Q86UA1
  ENST ID: ENST00000355765
  CDS Start-End: 171-2180
actgacgcatgcgcatcgtgccctggaccaggcggccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagtaa

SEQ ID NO: 168934 - DNA, 3174 bp, Homo sapiens
  Payload ID: 13255
  Gene Symbol: PRPF39
  Gene Name: pre-mRNA processing factor 39
  ENST ID: ENST00000424478
  CDS Start-End: 142-600
aggcggccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtgcgttaaacctctacagtttgtcaagctttgcagtgcaagcctctgtattacactgcagcttaacaagtagggcagggcttttctctcacttacatttatttctcattttccaaacaatatagttggtttgctagtcacatttgctacgtcttattgcatttttggtcagacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagtaa

SEQ ID NO: 168935 - DNA, 2977 bp, Homo sapiens
  Payload ID: 13255
  Gene Symbol: PRPF39
  Gene Name: pre-mRNA processing factor 39
  ENST ID: ENST00000554429
  CDS Start-End: 2-460
tatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtgcgttaaacctctacagtttgtcaagctttgcagtgcaagcctctgtattacactgcagcttaacaaacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaaggagatggtctgcttgcaaccagatttgactgctgcatatgccaacctcgttgcctctcttcgtccttccttacagaaactagtctagtggttcaataaagtatgccaagtacatggaaaaccatagcattgaaggagtgaggcatgtcttcagcagagcttgtactatacatctcccaaagaaacccatggtgcatatgctttgggcagcttttgaggaacagcagggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagtaa

SEQ ID NO: 168936 - DNA, 2982 bp, Homo sapiens
  Payload ID: 13255
  Gene Symbol: PRPF39
  Gene Name: pre-mRNA processing factor 39
  ENST ID: ENST00000554439
  CDS Start-End: 20-478
atcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtgcgttaaacctctacagtttgtcaagctttgcagtgcaagcctctgtattacactgcagcttaacaaacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagtaattgtttatgaatttattttggggggatcaatta

SEQ ID NO: 168937 - DNA, 3223 bp, Homo sapiens
  Payload ID: 13255
  Gene Symbol: PRPF39
  Gene Name: pre-mRNA processing factor 39
  ENST ID: ENST00000554081
  CDS Start-End: 1-52
gcggcacgacaacattaaaccatcagatgagacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaaggagatggtctgcttgcaaccagatttgactgctgcatatgccaacctcgttgcctctcttcgtccttccttacagaaactagtctagtggttcaataaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagtaattgtttatgaatttattttggggggatcaattagtaatattaaccttatgttcacctttattagtggctcattggttttgaagtacaccttttctaaattcaggtcttgatcttcctgccaagatttttctgcttttagcattttgtttcccctcaagccttatgcttttgccttctcattatacaggcaatctgtccagataattttactgggagttactccctggtttgatgaggtccttagttccaattccctaatcagaacaataatatattaacaccaaacaaatcacagtcagatcaagacagtggatcaatttttattgagccacttaagtttacaacatgaggtaaaaggaaaaagttctccttgaccagtattttacacagctgtaggaaagtattttagaccagggattcataagggatttatctctcaaaagctgggaccaagtaaacaaattttattaactccttgaattttccagttgactcttcctttacaatagtaacaagttctaactagttgtgtaaatttcttcaaggccaagttttatcattgttgctaatatccttagagctgaagcactgctatttcaatcaatatccactaattccacttcaaaagtgagttttgcatttggtggaattctgttgaagaagtcaaggtacatttgataa

SEQ ID NO: 168938 - DNA, 582 bp, Homo sapiens
  Payload ID: 13255
  Gene Symbol: PRPF39
  Gene Name: pre-mRNA processing factor 39
  ENST ID: ENST00000553605
  CDS Start-End: 163-582
atgcgcatcgtgccctggaccaggcggccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctggaatcacttgatggctgccaggaaggcatttgacagatttttcatacactatccgtattgctatggttactggaaaaagtatgcagaccttgaaaagcggcacgacaacattaaaccatcagatgag

SEQ ID NO: 168939 - DNA, 724 bp, Homo sapiens
  Payload ID: 13255
  Gene Symbol: PRPF39
  Gene Name: pre-mRNA processing factor 39
  ENST ID: ENST00000557477
  CDS Start-End: 1-272
aggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaaggagatggtctgcttgcaaccagatttgactgctgcatatgccaacctcgttgcctctcttcgtccttccttacagaaactagtctagtggttcaataaagtatgccaagtacatggaaaaccatagcattgaaggagtgaggcatgtcttcagcagagcttgtactatacatctcccaaagaa

SEQ ID NO: 168940 - DNA, 2787 bp, Homo sapiens
  Payload ID: 13256
  Gene Symbol: PRPF4
  Gene Name: pre-mRNA processing factor 4
  Uniprot ID: O43172
  ENST ID: ENST00000374198
  CDS Start-End: 103-1671
acttcctgtcagtgacgcacttcccctctgctgggcgcgcggtggacggtctgaaagggagtgttcgggtttcgctggggcctcgcggctccagagcccagcatggcttcctcgcgagcctcttccacgcaggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaa

SEQ ID NO: 168941 - DNA, 3212 bp, Homo sapiens
  Payload ID: 13256
  Gene Symbol: PRPF4
  Gene Name: pre-mRNA processing factor 4
  Uniprot ID: O43172
  ENST ID: ENST00000374199
  CDS Start-End: 402-1967
cagagttcagccccgagccgcgcgagtcgactcacctacctcttttcaagccggcctagccccttcccggaacctcggctcccccccaacgaaactactgctaagccaactggactacacttcccagactgcttggagcctctctctccgcagaacctcgtcttccgcgagcttttcctggaggttctaggagggatgcccctcaatgccacgacgccatttcctactacgacttccatcatgctccgcgccgctccgggggcggtgacccctcttggcccacgtcttgtcagtgacgcacttcctgtcagtgacgcacttcccctctgctgggcgcgcggtggacggtctgaaagggagtgttcgggtttcgctggggcctcgcggctccagagcccagcatggcttcctcgcgagcctcttccacggcaaccaaaactaaagcacccgacgacttagttgctccggtcgtgaagaaaccacacatctattatggaagtttggaagagaaggagagggagcgtctggccaaaggagagtctgggattttggggaaagacggacttaaagcagggatcgaagctggaaatattaatataacctctggagaagtgtttgaaattgaagagcatatcagcgagcgacaggcagaagtattggctgagtttgagagaaggaagcgagcccggcagatcaatgtttccacagatgactcagaggtcaaagcttgccttagagccttgggggaacccatcacactttttggagagggtcctgctgaaagaagagaaaggttaagaaatatcctctcagttgtcggtactgatgccttgaaaaagaccaaaaaggatgatgagaagtctaaaaagtccaaagaagagtatcagcaaacctggtatcatgaaggaccaaatagcttgaaggtggcaagactatggattgctaattattcgttgcccagggcaatgaaacgcttggaagaggcccgactccataaggagattcctgagacaacaaggacctcccagatgcaagagctgcacaagtctctccggtctttgaataatttttgcagtcagattggggatgatcggcctatctcctactgtcactttagtcccaattccaagatgctggccacagcttgttggagtgggctttgcaagctctggtctgttcctgattgcaacctccttcacactcttcgagggcataacacaaatgtaggagcaattgtattccatcccaaatccactgtctccttggacccaaaagatgtcaacctggcctcttgtgcggctgatggctctgtgaagctttggagtctcgacagtgatgaaccagtggcagatattgaaggccatacagtgcgtgtggcgcgggtaatgtggcatccttcaggacgtttcctgggcaccacctgctatgaccgttcatggcgcttatgggatttggaggctcaagaggagatcctgcatcaggaaggccatagcatgggtgtgtatgacattgccttccatcaagatggctctttggctggcactgggggactggatgcatttggtcgagtttgggacctacgcacaggacgttgtatcatgttcttagaaggccacctgaaagaaatctatggaataaatttctcccccaatggctatcacattgcaaccggcagtggtgacaacacctgcaaagtgtgggacctccgacagcggcgttgcgtctacaccatccctgctcatcagaacttagtgactggtgtcaagtttgagcctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatccta

SEQ ID NO: 168942 - DNA, 4415 bp, Homo sapiens
  Payload ID: 13257
  Gene Symbol: PRPF4B
  Gene Name: pre-mRNA processing factor 4B
  Uniprot ID: Q13523
  ENST ID: ENST00000337659
  CDS Start-End: 101-3124
ggcacatgcgcggcagctcttttccttcttcctccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagagattattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggca

SEQ ID NO: 168943 - DNA, 6775 bp, Homo sapiens
  Payload ID: 13257
  Gene Symbol: PRPF4B
  Gene Name: pre-mRNA processing factor 4B
  Uniprot ID: Q13523
  ENST ID: ENST00000480058
  CDS Start-End: 160-3183
ggggttttatatccggattcttagcgcggactcagaacccagctcttccctacacggtcggcacatgcgcggcagctcttttccttcttcctccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagagattattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctgaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatc

SEQ ID NO: 168944 - DNA, 2364 bp, Homo sapiens
  Payload ID: 13257
  Gene Symbol: PRPF4B
  Gene Name: pre-mRNA processing factor 4B
  ENST ID: ENST00000481109
  CDS Start-End: 1-1764
ctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggcataaaccttccactcttgaacaaagcagctgctttttaaaagcgagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 168945 - DNA, 3044 bp, Homo sapiens
  Payload ID: 13258
  Gene Symbol: PRPF6
  Gene Name: pre-mRNA processing factor 6
  Uniprot ID: O94906
  ENST ID: ENST00000266079
  CDS Start-End: 112-2937
ggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaa

SEQ ID NO: 168946 - DNA, 7295 bp, Homo sapiens
  Payload ID: 13259
  Gene Symbol: PRPF8
  Gene Name: pre-mRNA processing factor 8
  Uniprot ID: Q6P2Q9
  ENST ID: ENST00000304992
  CDS Start-End: 115-7122
gaactcgggttgcgcacttcccggcgctgggaacgcggagcggacgcagtctggccgccattgcgctgcggggaaagcggcctcttgtgtgagggcctgtgggattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 168947 - DNA, 3274 bp, Homo sapiens
  Payload ID: 13259
  Gene Symbol: PRPF8
  Gene Name: pre-mRNA processing factor 8
  ENST ID: ENST00000577001
  CDS Start-End: 237-3274
agcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgcc

SEQ ID NO: 168948 - DNA, 380 bp, Homo sapiens
  Payload ID: 13259
  Gene Symbol: PRPF8
  Gene Name: pre-mRNA processing factor 8
  ENST ID: ENST00000571958
  CDS Start-End: 1-350
cccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagga

SEQ ID NO: 168949 - DNA, 7445 bp, Homo sapiens
  Payload ID: 13259
  Gene Symbol: PRPF8
  Gene Name: pre-mRNA processing factor 8
  Uniprot ID: Q6P2Q9
  ENST ID: ENST00000572621
  CDS Start-End: 267-7274
gcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggacgcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaaaagcggaagtttgggtttgtggatgcccagaaggaagacatgcccccagaacatgtcaggaagatcattcgagaccatggagacatgaccaacaggaagttccgccatgacaaaagggtttacttgggtgccctaaagtacatgccccacgcagtcctcaaactcctggagaacatgcctatgccttgggagcagattcgggatgtgcctgtgctgtaccacatcactggagccatttccttcgtcaatgagattccctgggtcattgaacctgtctacatctcccagtgggggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgttgagggacagcaggaagtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacaggatgaagactggaatgaattcaatgatattaacaagattatcatccggcagcctatccgcactgagtacaagattgcttttccttacttgtacaacaatcttccacaccatgtccacctcacctggtaccatactcccaatgttgtattcatcaaaactgaggatcctgacttgccagctttctactttgaccctttgatcaacccaatctcccataggcactcagtcaagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggaaagaaagaaatctcgttttgggaatgctttccacctgtgtcgggaagttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacgggccctgtagggaagggtcctggctgtggcttctgggctgccggttggcgagtctggctctttttcatgcgtggcattacccctttattagagcgatggcttggcaacctcctggcccggcagtttgaaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttatagtgtgaagtctcggttgaaccagtctcagagggaggagctaggtctgatcgagcaggcctacgataacccccacgaggcgctgtcccgcatcaagcgtcacctcctcacacagagagccttcaaagaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggacatgaaccatacgaattcatatgggatcatcagaggcctgcagtttgcctcattcatcgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggttactaaggagcgcacagctcagtgtttcctgcgtgtggacgatgagtcaatgcagcgcttccacaaccgcgtgcgtcagattctcatggcctctgggtccaccaccttcaccaagattgtgaataagtggaatacagctctcattggccttatgacatactttcgggaggctgtggtgaacacccaagagctcttggacttactggtgaagtgtgagaacaaaatccagacacgtatcaagattggactcaactccaagatgccaagtcggttccccccggttgtgttctacacccctaaggagttgggtggactcggcatgctctcaatgggccatgtgctcatcccccaatccgacctcaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaaggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaagacctttgaagggaacttgacaaccaagcccatcaacggagccatcttcatcttcaacccacgcacagggcagctgttcctcaagataatccacacgtccgtgtgggcgggacagaagcgtttggggcagttggctaagtggaagacagctgaggaggtggccgccctgatccgatctctgcctgtggaggagcagcccaagcagatcattgtcaccaggaagggcatgctggacccactggaggtgcacttactggacttccccaatattgtcatcaaaggatcggagctccaactccctttccaggcgtgtctcaaggtggaaaaattcggggatctcatccttaaagccactgagccccagatggttctcttcaacctctatgacgactggctcaagactatttcatcttacacggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaatgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcagggccatctctgctgccaacctgcacctaaggaccaatcacatctatgtttcatctgacgacatcaaggagactggctacacctacatccttcccaagaatgtgcttaagaagttcatctgcatatctgaccttcgggcccaaattgcaggatacctatatggggtgagcccaccagataacccccaggtgaaggagatccgctgcattgtgatggtgccgcagtggggcactcaccagaccgtgcacctgcctggccagctgccccagcatgagtacctcaaggagatggaacccttaggttggatccacactcagcccaatgagtccccgcagttatcaccccaggatgtcaccacccatgccaagatcatggctgacaacccatcttgggatggcgagaagaccattatcatcacatgcagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatag

SEQ ID NO: 168950 - DNA, 749 bp, Homo sapiens
  Payload ID: 13259
  Gene Symbol: PRPF8
  Gene Name: pre-mRNA processing factor 8
  ENST ID: ENST00000573725
  CDS Start-End: 1-749
cacgtatcaagattggactcaactccaagatgccaagtcggttccccccggttgtgttctacacccctaaggagttgggtggactcggcatgctctcaatgggccatgtgctcatcccccaatccgacctcagacgcctgactttagaagacctagaagattcatgggatcgtggcattcctcgaatcaataccctcttccagaaggaccggcacacactggcttatgataagggctggcgtgtcagaactgactttaagcagtatcaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctgggagaaggccagtggctttgaggaatctatgaagtggaagaagctaactaatgctcagcgatcaggactgaaccagattcccaatcgtagattcaccctctggtggtccccgaccattaatcgagccaatgtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgtttgaccaggaacttgatgcactggaaatt

SEQ ID NO: 168951 - DNA, 7295 bp, Homo sapiens; identical to SEQ ID NO: 168946
  Payload ID: 13259
  Gene Symbol: PRPF8
  Gene Name: pre-mRNA processing factor 8
  Uniprot ID: Q6P2Q9
  ENST ID: ENST00000614672
  CDS Start-End: 115-7122

SEQ ID NO: 168952 - DNA, 3274 bp, Homo sapiens; identical to SEQ ID NO: 168947
  Payload ID: 13259
  Gene Symbol: PRPF8
  Gene Name: pre-mRNA processing factor 8
  ENST ID: ENST00000631647
  CDS Start-End: 237-3274

SEQ ID NO: 168953 - DNA, 7445 bp, Homo sapiens; identical to SEQ ID NO: 168949
  Payload ID: 13259
  Gene Symbol: PRPF8
  Gene Name: pre-mRNA processing factor 8
  Uniprot ID: Q6P2Q9
  ENST ID: ENST00000634039
  CDS Start-End: 267-7274

SEQ ID NO: 168954 - DNA, 1626 bp, Homo sapiens
  Payload ID: 13260
  Gene Symbol: PDSS1
  Gene Name: prenyl (decaprenyl) diphosphate synthase, subunit 1
  Uniprot ID: Q5T2R2
  ENST ID: ENST00000376215
  CDS Start-End: 54-1301
atcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaa

SEQ ID NO: 168955 - DNA, 897 bp, Homo sapiens
  Payload ID: 13260
  Gene Symbol: PDSS1
  Gene Name: prenyl (decaprenyl) diphosphate synthase, subunit 1
  ENST ID: ENST00000491711
  CDS Start-End: 1-476
tctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcaggttcactgccagggaaaaactggcagctgctgtaagcactgacgtggccaaaatcaaacacatcttacctcttccgtggagccatagactgttagagctcaagggcttccagtcatgaagatgagaagcctaagaccccaggggctaaggaagtcactcggctgtggcagctgttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacact

SEQ ID NO: 168956 - DNA, 1236 bp, Homo sapiens
  Payload ID: 13261
  Gene Symbol: PDSS2
  Gene Name: prenyl (decaprenyl) diphosphate synthase, subunit 2
  Uniprot ID: Q86YH6
  ENST ID: ENST00000369031
  CDS Start-End: 280-1002
atgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaagtcattttcatttaatggacctattgctatatatcagatgggagactgtgagtcagcctggatcttgtctaaacacccaagagcattgtcatgatgtcactcctggaggttgttctattaagcattagtgatttatacttccggataaccagtggcacagatgtactctttacatagctgatgtatttccttatgttaactttgttttcctaaaggcgtaaatatgttgtttaaaatgaagtattttgtttgtacaaatatgctcaatttatgcatataaatctccctttacaccatctatatagtttaataaagatgctattgtcta

SEQ ID NO: 168957 - DNA, 3540 bp, Homo sapiens
  Payload ID: 13261
  Gene Symbol: PDSS2
  Gene Name: prenyl (decaprenyl) diphosphate synthase, subunit 2
  Uniprot ID: Q86YH6
  ENST ID: ENST00000369037
  CDS Start-End: 279-1478
tgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagaggctcaagaaaaaggaagattggactatgctaagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaattttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaagagattaaacaagataattatgaaattctt

SEQ ID NO: 168958 - DNA, 241 bp, Homo sapiens
  Payload ID: 13261
  Gene Symbol: PDSS2
  Gene Name: prenyl (decaprenyl) diphosphate synthase, subunit 2
  ENST ID: ENST00000449027
  CDS Start-End: 1-241
gttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagagtcttcaagtacagaagttcaactttctaactttcaacaaatgctactttcaacactct

SEQ ID NO: 168959 - DNA, 2959 bp, Homo sapiens
  Payload ID: 13262
  Gene Symbol: PCYOX1
  Gene Name: prenylcysteine oxidase 1
  ENST ID: ENST00000264441
  CDS Start-End: 17-898
agagcttgtggaggccatggggcgcgtcgtcgcggagctcgtctcctcgctgctggggttgtggctgttgctgtgcagctgcggatgccccgagggcgccgagctgcgtgctccgccagataaaatcgcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcataggaaaacacacggttctaattaagtgtgaaggtatagctattgcacttatgccatctccaaaatttcttaagtattctttcactatccattaggagtttttcttaaacttgtctgataataagaatcacctggagttaggaggtggtggttgcagtgagccaatctcaccattgcacttcagcctgagcaacacgagcaaaactccgtctcaaaagtaaataaaaataatcacctggagtttgttaaaccatatggattctcaagctcctctcttgaagattctgattcagtaggtctgggagtggcgcgctggattttgatcaaaattgtagagcattttaaggtgagtacctgagggagaacttaaagacatcttagttggggagtagtccttttgaattttacagctagatataatcttcagtcagataaaatttatgggagctggtgtcttatgcctgactcttagtaatttcataccggtttgaagtacgtgtgcccatgcctaaagccttgactttcagaatgttgtcttttgattcttctgtcttgatttgattaggggtgaaatttagaagtcttagtaatgtaacttgaagatgttaaacaaaaatctcaagtaaaatgaaaagcaaatatgggctactgaattaagaaactggcattctagtattaaatcctcacttcaggagcttttaaaaatactgagacccccccataaccagagattcagattcaaagactgaggataggaccttagcattgtagctatttaaagtttctaatgtgcacccagggttgggaatcaccaatgtgggtgtgaaaatgcctacaaagggttttagtgccttagaagtcctaagaagcccaatctgtatcaaagcagatccattttgcaaggatctttcttttagaactttctcagttctcttagtaagaactttagaagtaatcttgataataagcacagacagcctaacagcagaggcaacttaaataactcctgagcagttggcactagaacagaatacttggaatgacaccaaagttaaccaagtccagcatatgtccaaagagttaagtgtttcatttactgtagcattctgggtgagaaattggttgctgaaatcttaagacagtggtctcaaccttggctgcacattggaatcacctgtagggttttaaagcatccaaatggtaattaacaggcagcaaaacttcagaactagttctgcatctactgtgcaaagatcatgattaactgtcaagacactggtagaacagaacaagcaaaagattaagagttcaaaagtaaatgcaaccaatttaacatgtagtgttattaaaaaattacaaaggcctagaccagcctgggcaacatggtgaaaccccatctctacaaaaaatttttaaaaagttggccaggcatggtaatgcgcgcctgtggtcccagctgctcgggaggctgaggtgggaggatcacttgagccttggaggtcaaggctgcagtgaatcatgatcatgccactgtactccagcctgggcaacagagaccatcttaaaaaaaaaaaa

SEQ ID NO: 168960 - DNA, 5345 bp, Homo sapiens
  Payload ID: 13262
  Gene Symbol: PCYOX1
  Gene Name: prenylcysteine oxidase 1
  Uniprot ID: Q9UHG3
  ENST ID: ENST00000433351
  CDS Start-End: 29-1546
gaggccagctgcagagcttgtggaggccatggggcgcgtcgtcgcggagctcgtctcctcgctgctggggttgtggctgttgctgtgcagctgcggatgccccgagggcgccgagctgcgtgctccgccagataaaatcgcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacaggaaatccaacaaagatgtatgaagtggtctaccaaattggaactgagactcgttcagacttctatgacatcgtcttggtggccactccgttgaatcgaaaaatgtcgaatattacttttctcaactttgatcctccaattgaggaattccatcaatattatcaacatatagtgacaactttagttaagggggaattgaatacatctatctttagctctagacccatagataaatttggccttaatacagttttaaccactgataattcagatttgttcattaacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcataggaaaacacacggttctaattaagtgtgaaggtatagctattgcacttatgccatctccaaaatttcttaagtattctttcactatccattaggagtttttcttaaacttgtctgataataagaatcacctggagttaggaggtggtggttgcagtgagccaatctcaccattgcacttcagcctgagcaacacgagcaaaactccgtctcaaaagtaaataaaaataatcacctggagtttgttaaaccatatggattctcaagctcctctcttgaagattctgattcagtaggtctgggagtggcgcgctggattttgatcaaaattgtagagcattttaaggtgagtacctgagggagaacttaaagacatcttagttggggagtagtccttttgaattttacagctagatataatcttcagtcagataaaatttatgggagctggtgtcttatgcctgactcttagtaatttcataccggtttgaagtacgtgtgcccatgcctaaagccttgactttcagaatgttgtcttttgattcttctgtcttgatttgattaggggtgaaatttagaagtcttagtaatgtaacttgaagatgttaaacaaaaatctcaagtaaaatgaaaagcaaatatgggctactgaattaagaaactggcattctagtattaaatcctcacttcaggagcttttaaaaatactgagacccccccataaccagagattcagattcaaagactgaggataggaccttagcattgtagctatttaaagtttctaatgtgcacccagggttgggaatcaccaatgtgggtgtgaaaatgcctacaaagggttttagtgccttagaagtcctaagaagcccaatctgtatcaaagcagatccattttgcaaggatctttcttttagaactttctcagttctcttagtaagaactttagaagtaatcttgataataagcacagacagcctaacagcagaggcaacttaaataactcctgagcagttggcactagaacagaatacttggaatgacaccaaagttaaccaagtccagcatatgtccaaagagttaagtgtttcatttactgtagcattctgggtgagaaattggttgctgaaatcttaagacagtggtctcaaccttggctgcacattggaatcacctgtagggttttaaagcatccaaatggtaattaacaggcagcaaaacttcagaactagttctgcatctactgtgcaaagatcatgattaactgtcaagacactggtagaacagaacaagcaaaagattaagagttcaaaagtaaatgcaaccaatttaacatgtagtgttattaaaaaattacaaaggcctagaccagcctgggcaacatggtgaaaccccatctctacaaaaaatttttaaaaagttggccaggcatggtaatgcgcgcctgtggtcccagctgctcgggaggctgaggtgggaggatcacttgagccttggaggtcaaggctgcagtgaatcatgatcatgccactgtactccagcctgggcaacagagaccatcttaaaaaaaaaaaatccttccattgaatagaaacttcaaagtccttcatcagatcatggcattagctactttagcaaaatagtgtaaactttggttctgagtaaaaatgacttcttccctaccacagttgtgaatgttaatatgctgataaaactgccaagatatatttgataggtaggggattaaactcatggtttgtcaaaagagtgtttttttctagttttattcttaacagatatgttgaggtattcatatttgtttccttttgtggttttaatgaagacaatttgtaaagtaatactgttatgtatatgctaaatgttggtaaatactaattaatttccatcatttgtagacttgttttgcaatgggatatatttttacttataataccaatttaggctgggcgcagtggctcacgcctgtaatcccagcactttgggaggccaaggcaaacggatcacgaggtcaggagatcaagaccatcctggccaacatggtgaaaccccatctctactgaatacacaaaaattggctggacatggtggcgcatgtctgtaatcccagctactgtaatctcagctacttgggaggctgaggcaggagaattgcctcaaccgggaggcggaggttgcagtgagccaagatcgcaccactgcactccagcctggcaacagagcgagactctgtctcagaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggaggctgaggcgcgagaatcgcttgaaccctggagatggaggttgcagtgagcagagatcgcaccactgcactccagcctgggcaagagtgagactgtgtctcaaaaggaaaaaaaaaaaattaaaaatgttgctggtattacatcaaacctactctggataaattttccagtagggcatctgaaattgctttggcaaaagcaaaacaggttatcaatacaccaaggacatcaagtagttttaatgcaactacagtgttgagtgcttttttactgggagaaaaatcctagcagaacctgctactctgggcgcattaggtagttttatgcaactatagtattaagagttttattggaagaaaaaacactgtcagagcttactgctccagacctttttttttaatagaagagactggtaaaaatgatgcaggggctgaatgaaagccagctctgctccagtggctctctgagttgagcatgcatcagttaccttaagggcttgttaaaacatcgctaggctccaccctgtttattcaataagtttgttatgggatataagaagatgcattttattaagttccccagtgatgctgctgttctactataggaaccacacttgaagaactagttctacaattcagctgtatgttgtaaaggagtcaagtcaatgaaggagttataaagagttgctgaaaaatggagtaacagtgtatgggacttcacatcagttctccttattgattgttagtttgatccctcttgttcttttgttgtaaacattttctataattaggaaatgccatttaagagtgagagaggtatatatctatgagccattgtgtttggtgttttacaagaactttaccatactggtgtgtagtccattctgtacagtttaaaagtgattcacgatttgcaggctttttatcagatcacaaaaaaatcagtctttaagcatttgcttggtaaggtttcttaagattaggtttataatacaaccatctgtaatgtatctctcgtttgagcttgtgggccatacaattcattaactagatgaatacattgtggacagcatcctcactacccctctctactcactcacaaagaaccatgatacactggaatgtttttctctggaatcctctttctactcttgtattaaaatttttccccacttcatgattatattcaaaataaacaactacatcattacttctt

SEQ ID NO: 168961 - DNA, 556 bp, Homo sapiens
  Payload ID: 13262
  Gene Symbol: PCYOX1
  Gene Name: prenylcysteine oxidase 1
  ENST ID: ENST00000422380
  CDS Start-End: 168-556
acccattcacggagaaccttacagttctcgcaacagggtgatcactcacgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccgg

SEQ ID NO: 168962 - DNA, 648 bp, Homo sapiens
  Payload ID: 13262
  Gene Symbol: PCYOX1
  Gene Name: prenylcysteine oxidase 1
  ENST ID: ENST00000451279
  CDS Start-End: 186-648
attcacacttcagggcggctttcagctctggtcggaataggactgtgcattcccaggcgtggagagcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatca

SEQ ID NO: 168963 - DNA, 957 bp, Homo sapiens
  Payload ID: 13262
  Gene Symbol: PCYOX1
  Gene Name: prenylcysteine oxidase 1
  ENST ID: ENST00000414812
  CDS Start-End: 330-957
ctcccgagtagctgggactacaggcgcccgccactatgccgagctaaatttttgtatttttagtagagacggggtttcaccgtgttagccaggatggtctcgatctcctgacctcatgatccacccacctcggcctcccaaagtgctgggattacaggcttgagccaccgcgcccggccagcttctgccttcgatgtcttctgaaggaggcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacag

SEQ ID NO: 168964 - DNA, 2546 bp, Homo sapiens
  Payload ID: 13263
  Gene Symbol: PCYOX1L
  Gene Name: prenylcysteine oxidase 1 like
  Uniprot ID: Q8NBM8
  ENST ID: ENST00000274569
  CDS Start-End: 63-1547
ggagagccgagcgccaacccgctagcgcctgaatccggcgtgctgcccgctcgccgcccgccatggcccgcgcagccccgctgctcgccgcgttgaccgcgctcctcgccgccgccgctgctggcggagatgccccgccgggcaaaatcgcggtggttggggctgggattgggggctctgctgtggcccattttctccagcagcactttggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgaggatctataagtaccaggcccacggctatgccttctcgggtgtggaggagctgctctactcactgggggagtccacctttgttaacatgacccagcactctgtggctgagtccctgctgcaggtgggcgtcacgcagcgctttattgatgatgtcgtttctgctgtcctgcgggccagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatggatttgaagtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattcc

SEQ ID NO: 168965 - DNA, 582 bp, Homo sapiens
  Payload ID: 13263
  Gene Symbol: PCYOX1L
  Gene Name: prenylcysteine oxidase 1 like
  ENST ID: ENST00000510990
  CDS Start-End: 33-368
gaatccggcgtgctgcccgctcgccgcccgccatggcccgcgcagccccgctgctcgccgcgttgaccgcgctcctcgccgccgccgctgctggcggagatgccccgccgggcaaaatcgcggtggttggggctgggattgggggctctgctgtggcccattttctccagcagcactttggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggatggagcaacagaaacaagagaggggaaggaacttgcctgaggttacacaggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgaggatctataagtaccaggcccacggctatgc

SEQ ID NO: 168966 - DNA, 2500 bp, Homo sapiens
  Payload ID: 13263
  Gene Symbol: PCYOX1L
  Gene Name: prenylcysteine oxidase 1 like
  Uniprot ID: Q8NBM8
  ENST ID: ENST00000511945
  CDS Start-End: 1-249
atggcccgcgcagccccgctgctcgccgcgttgaccgcgctcctcgccgccgccgctgctggcggagatgccccgccgggcaaaatcggtgcgggaaggacgcgcggtggttggggctgggattgggggctctgctgtggcccattttctccagcagcactttggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgaggatctataagtaccaggcccacggctatgccttctcgggtgtggaggagctgctctactcactgggggagtccacctttgttaacatgacccagcactctgtggctgagtccctgctgcaggtgggcgtcacgcagcgctttattgatgatgtcgtttctgctgtcctgcgggccagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatggatttgaagtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattcc

SEQ ID NO: 168967 - DNA, 2323 bp, Homo sapiens
  Payload ID: 13263
  Gene Symbol: PCYOX1L
  Gene Name: prenylcysteine oxidase 1 like
  Uniprot ID: Q8NBM8
  ENST ID: ENST00000505669
  CDS Start-End: 1-249
atggcccgcgcagccccgctgctcgccgcgttgaccgcgctcctcgccgccgccgctgctggcggagatgccccgccgggcaaaatcggtgcgggaaggacgcgcggtggttggggctgggattgggggctctgctgtggcccattttctccagcagcactttggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatggatttgaagtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattcc

SEQ ID NO: 168968 - DNA, 2793 bp, Homo sapiens
  Payload ID: 13263
  Gene Symbol: PCYOX1L
  Gene Name: prenylcysteine oxidase 1 like
  ENST ID: ENST00000514349
  CDS Start-End: 580-1794
ccaaacactgatcactgaacagaactggtcagtaacttttaacaattcatagggaaataagaaagttagaagcaaggtagtgagttttatataaaactaaatttattctctttaattggtcatcctgactttcagtattctttgctggtcttttgctgcaaaatacctttttctttatgaaacgaaagtatagtaggcagcagttttcaggtttgcctttgcttattaatagctctactgacaactcagtccgcagatttccttttggaaatgttataagcctaggaaatttaagcacctgggaaccaccagcgcaggaggatacaaagtgtgaactacagcctctcactctcatgttctgtctctcttcttccctacctcccgggcctgctgacagcggtggttggggctgggattgggggctctgctgtggcccattttctccagcagcactttggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgaggcaccggcgcgaggtggtgggcaggagcgccatcttcggcggggagcacttcatgctggaggagactgactggtacctgctgaacctcttccgcctctggtggcactatggcatcagcttcctgaggctgcagatgtgggtggaggaggtcatggagaagttcatgaggatctataagtaccaggcccacggctatgccttctcgggtgtggaggagctgctctactcactgggggagtccacctttgttaacatgacccagcactctgtggctgagtccctgctgcaggtgggcgtcacgcagcgctttattgatgatgtcgtttctgctgtcctgcgggccagctatggccagtcagcagcgatgcccgcctttgcaggagccatgtcactagccggggcccaaggcagcctgtggtctgtggaaggaggcaataagctggtttgttccggtttgctgaagctcaccaaggccaatgtgatccatgccacagtgacctctgtgaccctgcacagcacagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatggatttgaagtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattcc

SEQ ID NO: 168969 - DNA, 1200 bp, Homo sapiens
  Payload ID: 13264
  Gene Symbol: PNOC
  Gene Name: prepronociceptin
  Uniprot ID: Q13519
  ENST ID: ENST00000301908
  CDS Start-End: 209-739
gccaggaaggcttgcaggttctgctgtttggttgctgaagggggtcagtgtgtgtatgtgtcatggaggtgggcagggaaggggagggctgtgcgtgggggagaggatatatatgctggtgtggctgagaaagcggaaccgagcctcgcatccatcggagggagccggggactgacagctctcagcacctgcttcctgctcctgcaccatgaaagtcctgctttgtgacctgctgctgctcagtctcttctccagtgtgttcagcagttgtcagagggactgtctcacatgccaggagaagctccacccagccctggacagcttcgacctggaggtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaataaa

SEQ ID NO: 168970 - DNA, 554 bp, Homo sapiens
  Payload ID: 13264
  Gene Symbol: PNOC
  Gene Name: prepronociceptin
  ENST ID: ENST00000518479
  CDS Start-End: 92-554
tcagtcctcacagagcctctggaagcacagggaaggcagctgtgggatcctggctgaacagagtccagcacctgcttcctgctcctgcaccatgaaagtcctgctttgtgacctgctgctgctcagtctcttctccagtgtgttcagcagttgtcagagggactgtctcacatgccaggagaagctccacccagccctggacagcttcgacctggaggtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggc

SEQ ID NO: 168971 - DNA, 1007 bp, Homo sapiens
  Payload ID: 13264
  Gene Symbol: PNOC
  Gene Name: prepronociceptin
  Uniprot ID: Q13519
  ENST ID: ENST00000522209
  CDS Start-End: 208-546
agaacaaaataaaattctttatgggtgacagtcatgagctgtgcttggctccaaaaacccgactaaagatgtaacaaggtgcggtgttgggcgcatttatcctgtgttaacttcctatgttaacgtgctgtgacaccagaggtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaataaa

SEQ ID NO: 168972 - DNA, 6078 bp, Homo sapiens
  Payload ID: 13265
  Gene Symbol: PSEN1
  Gene Name: presenilin 1
  Uniprot ID: P49768
  ENST ID: ENST00000324501
  CDS Start-End: 273-1676
cggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgccacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttcctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctcagacagtgtatgtattctcgatataacttgtagagtgtgaaatataagtttaactaccaaataaggtctcccagggttagatgactgcgggaagcctttgatcccaacccccaaggctttgtatatttgatcatttgtgatctaaccctggaagaaaaagagctcagaaaccactatgaaaaaatttgttcagtgttttctgtgttcccgtaggttctggagtctgaggatgcaaagatgaataagataaattctcagaatgtagttataatctcttgttttctggtatatgccatctttctttaacttctctaaaatattgggtatttgtcaaataaccacttttaacagttaccattactgagggcttatacattggtgttataaaagtgacttgattcagaaatcaatccattcagtaaagtactccttctctaaatttgctgttatgtctataaggaacagtttgacctgcccttctcctcacctcctcacctgccttccaacattgaatttggaaggagacgtgaaaattggacatttggttttgcccttgggctggaaactatcatataatcataagtttgagcctagaagtgatccttgtgatcttctcacctctttaaattcccacaacacaagagattaaaaacagaggtttcagctcttcatagtgcgttgtgaaatggctggccagagtgtaccaacaaagctgtcatcgggctcacagctcagagacatctgcatgtgatcatctgcatagtcctctcctctaacgggaaacacctcagatttgcatataaaaaagcaccctggtgctgaaatgaacccctttcttgaacatcaaagctgtctcccacagccttgggcagcagggtgcctcttagtggatgtgctgggtccaccctgagccctgacatgtggtggcagcattgccagttggtctgtgtgtctgtgtagcagggacgatttcccagaaagcaattttccttttgaaatacgtaattgttgagactaggcagtttcaaagtcagctgcatatagtagcaagtacaggactgtcttgtttttggtgtccttggaggtgctggggtgagggtttcagtgggatcatttactctcacatgttgtctgccttctgcttctgtggacactgctttgtacttaattcagacagactgtgaatacaccttttttataaatacctttcaaattcttggtaagatataattttgatagctgattgcagattttctgtatttgtcagattaataaagactgcatgaatcca

SEQ ID NO: 168973 - DNA, 2776 bp, Homo sapiens
  Payload ID: 13265
  Gene Symbol: PSEN1
  Gene Name: presenilin 1
  Uniprot ID: P49768
  ENST ID: ENST00000357710
  CDS Start-End: 273-1664
cggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagc

SEQ ID NO: 168974 - DNA, 1249 bp, Homo sapiens
  Payload ID: 13265
  Gene Symbol: PSEN1
  Gene Name: presenilin 1
  Uniprot ID: P49768
  ENST ID: ENST00000394157
  CDS Start-End: 273-827
cggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcacttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataa

SEQ ID NO: 168975 - DNA, 3046 bp, Homo sapiens
  Payload ID: 13265
  Gene Symbol: PSEN1
  Gene Name: presenilin 1
  Uniprot ID: P49768
  ENST ID: ENST00000394164
  CDS Start-End: 543-1934
ggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagc

SEQ ID NO: 168976 - DNA, 4062 bp, Homo sapiens
  Payload ID: 13265
  Gene Symbol: PSEN1
  Gene Name: presenilin 1
  ENST ID: ENST00000406768
  CDS Start-End: 1823-2950
ttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcataaaaatatttcagctgggctgggtgcggtggctcactcctataatcccagcactttgggagaccgaggcaggtggatcacctggggtcaggagttcaagaccagcctggccaacatggcaaaaccgtatctctactaaaaatacaaaaattagttgggcatggtggtgggcaccataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcagctgggagaacaatataagcagctgacgtcagggatataaatggctgtgtgttgggaatacaagcagctgattgtcggaaatacaagccactgagtgttggtgatacaagtggctgagcagcgagcagagaatcaggtgagcgttggagactatggatgggacgtggctaacttcagatggtgcagctttggagaataggcccagccggagatggcctggcttcagggaaagatcaccttcttcccataccatccctttttcaactccccattctgctgagaaccacttccatcgtgcaatacaatcttctgcatatactacccttcaatctgttcatgtgatctgattattcctggacactggaagagaacctgggtgccaagaggagagggcaggggctgccaccctgaccctccactgagctggctggcacctggccatccccgaatggccgcgttgaaggagcattgattgtaacacacttggatgctgctgcggggccgcatagagcctgcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttatttacacttctctccttggtcatctttttactgtatttttccctccacagctatttcatccatttctgaggcctgagatttcatccatttctgaggctatagagaccagtgacttcctctgactcttctgagcttgaaattcctattgaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagc

SEQ ID NO: 168977 - DNA, 552 bp, Homo sapiens
  Payload ID: 13265
  Gene Symbol: PSEN1
  Gene Name: presenilin 1
  ENST ID: ENST00000556951
  CDS Start-End: 280-552
aatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtg

SEQ ID NO: 168978 - DNA, 754 bp, Homo sapiens
  Payload ID: 13265
  Gene Symbol: PSEN1
  Gene Name: presenilin 1
  ENST ID: ENST00000555254
  CDS Start-End: 288-754
ttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaata

SEQ ID NO: 168979 - DNA, 1484 bp, Homo sapiens
  Payload ID: 13265
  Gene Symbol: PSEN1
  Gene Name: presenilin 1
  Uniprot ID: P49768
  ENST ID: ENST00000555386
  CDS Start-End: 1-1125
atgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagagcctgtctgcctcctgctgccatcaacctgctgtctatagctcccatggcacccaggctgttcatgccaaagggtgcctgcaggcccacggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctag

SEQ ID NO: 168980 - DNA, 555 bp, Homo sapiens
  Payload ID: 13265
  Gene Symbol: PSEN1
  Gene Name: presenilin 1
  ENST ID: ENST00000557037
  CDS Start-End: 368-555
gagctacgagccgcggcggcagcggggcggcggggaagcgtatattcttctcaccgttgtggtcagctctgctttaggcatattaatccatagtggaggctgggatgggtgagagaattgaggtgacttttccataattcaggcatacaaatttattagcatgcagactgggagaaccacaagcctgggtgacagagcaagactgtgtctcaaaataaagacaggaacaaagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatga

SEQ ID NO: 168981 - DNA, 1230 bp, Homo sapiens
  Payload ID: 13265
  Gene Symbol: PSEN1
  Gene Name: presenilin 1
  Uniprot ID: P49768
  ENST ID: ENST00000557511
  CDS Start-End: 1-1230
atgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctag

SEQ ID NO: 168982 - DNA, 571 bp, Homo sapiens
  Payload ID: 13265
  Gene Symbol: PSEN1
  Gene Name: presenilin 1
  ENST ID: ENST00000557356
  CDS Start-End: 167-571
aacgacgccagagccggaaatgacgacaacgacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatg

SEQ ID NO: 168983 - DNA, 574 bp, Homo sapiens
  Payload ID: 13265
  Gene Symbol: PSEN1
  Gene Name: presenilin 1
  ENST ID: ENST00000556864
  CDS Start-End: 384-574
aaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatattcttctcaccgttgtggtcagctctgctttaggcatattaatccatagtggaggctgggatgggtgagagaattgaggtgacttttccataattcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgagga

SEQ ID NO: 168984 - DNA, 442 bp, Homo sapiens
  Payload ID: 13265
  Gene Symbol: PSEN1
  Gene Name: presenilin 1
  ENST ID: ENST00000556011
  CDS Start-End: 315-442
cggtgagggttctcgggcggggcctgggacaggcagctccggggtccgcggtttcacatcggaaacaaaacagcggctggtctggaaggaacctgagctacgagccgcggcggcagcggggcggcggggaagcaaaaggcatacaaatttattagcatgcagactgggagaaccacaagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagagacgagttctcgccatattggccaggctgatctcaaactc

SEQ ID NO: 168985 - DNA, 712 bp, Homo sapiens
  Payload ID: 13265
  Gene Symbol: PSEN1
  Gene Name: presenilin 1
  ENST ID: ENST00000553719
  CDS Start-End: 272-712
caacggtgagggttctcgggcggggcctgggacaggcagctccggggtccgcggtttcacatcggaaacaaaacagcggctggtctggaaggaacctgagctacgagccgcggcggcagcggggcggcggggaagcacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtg

SEQ ID NO: 168986 - DNA, 576 bp, Homo sapiens
  Payload ID: 13265
  Gene Symbol: PSEN1
  Gene Name: presenilin 1
  ENST ID: ENST00000557293
  CDS Start-End: 279-576
atgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctacca

SEQ ID NO: 168987 - DNA, 591 bp, Homo sapiens
  Payload ID: 13265
  Gene Symbol: PSEN1
  Gene Name: presenilin 1
  ENST ID: ENST00000554131
  CDS Start-End: 265-591
ggtttcacatcggaaacaaaacagcggctggtctggaaggaacctgagctacgagccgcggcggcagcggggcggcggggaagcgtatgcatacaaatttattagcatgcagactgggagaaccacaagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaag

SEQ ID NO: 168988 - DNA, 550 bp, Homo sapiens
  Payload ID: 13265
  Gene Symbol: PSEN1
  Gene Name: presenilin 1
  ENST ID: ENST00000556533
  CDS Start-End: 274-550
aaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcg

SEQ ID NO: 168989 - DNA, 1254 bp, Homo sapiens
  Payload ID: 13265
  Gene Symbol: PSEN1
  Gene Name: presenilin 1
  Uniprot ID: P49768
  ENST ID: ENST00000553855
  CDS Start-End: 1-1137
atgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagagcctgtctgcctcctgctgccatcaacctgctgtctatagctcccatggcacccaggctgttcatgccaaagggtgcctgcaggcccacggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattt

SEQ ID NO: 168990 - DNA, 612 bp, Homo sapiens
  Payload ID: 13265
  Gene Symbol: PSEN1
  Gene Name: presenilin 1
  ENST ID: ENST00000556066
  CDS Start-End: 439-612
tgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtg

SEQ ID NO: 168991 - DNA, 591 bp, Homo sapiens
  Payload ID: 13265
  Gene Symbol: PSEN1
  Gene Name: presenilin 1
  ENST ID: ENST00000553599
  CDS Start-End: 317-591
aacggtgagggttctcgggcggggcctgggacaggcagctccggggtccgcggtttcacatcggaaacaaaacagcggctggtctggaaggaacctgagctacgagccgcggcggcagcggggcggcggggaagcgtatgatttaactaacaatggatgacctggtgaaatcctatttcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggt

SEQ ID NO: 168992 - DNA, 699 bp, Homo sapiens
  Payload ID: 13265
  Gene Symbol: PSEN1
  Gene Name: presenilin 1
  ENST ID: ENST00000560005
  CDS Start-End: 371-699
gagggttctcgggcggggcctgggacaggcagctccggggtccgcggtttcacatcggaaacaaaacagcggctggtctggaaggaacctgagctacgagccgcggcggcagcggggcggcggggaagcgtatgctgggcacagtggctcacacctgtaatctgccagcactttgggaggccgaggcaggtagatcacctgaggtcaggagttcgagaccagcctcgccaaaatgacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgta

SEQ ID NO: 168993 - DNA, 795 bp, Homo sapiens
  Payload ID: 13265
  Gene Symbol: PSEN1
  Gene Name: presenilin 1
  ENST ID: ENST00000559361
  CDS Start-End: 198-371
agcggctggtctggaaggaacctgagctacgagccgcggcggcagcggggcggcggggaagcacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactagacgagttctcgccatattggccaggctgatctcaaactcctgggctcaagtaatcctcccactttggcctcccaaaatacagagattatgggtgtgagccatcatgcccagctggctagatatttcataatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataag

SEQ ID NO: 168994 - DNA, 2465 bp, Homo sapiens
  Payload ID: 13266
  Gene Symbol: PSEN2
  Gene Name: presenilin 2
  ENST ID: ENST00000366782
  CDS Start-End: 501-1946
ccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtgggtgtgaagctcagccctgagggtctctggacagcgatcactcagcctctggacagcgatcactcagcctctggacagacagcgatcactcagcctctggacagcgatcactcagcctctggacagcgatcactcagcctctggacagcgataactcagcctctgtccccgtctgagatgttggcagggactgtcagatttgccaggcattgtttgaagttcttcccagcccagaaacctgcatgtgtagattttggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaa

SEQ ID NO: 168995 - DNA, 2306 bp, Homo sapiens
  Payload ID: 13266
  Gene Symbol: PSEN2
  Gene Name: presenilin 2
  Uniprot ID: P49810
  ENST ID: ENST00000366783
  CDS Start-End: 437-1783
gcgtggggcggggcctgggccggcgccgggtccggccgggcgctcagccagctgcgtaaactccgctggagcgcggcggcagagcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatctt

SEQ ID NO: 168996 - DNA, 1947 bp, Homo sapiens
  Payload ID: 13266
  Gene Symbol: PSEN2
  Gene Name: presenilin 2
  Uniprot ID: P49810
  ENST ID: ENST00000422240
  CDS Start-End: 380-1723
aaactccgctggagcgcggcggcagagcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacagga

SEQ ID NO: 168997 - DNA, 1163 bp, Homo sapiens
  Payload ID: 13266
  Gene Symbol: PSEN2
  Gene Name: presenilin 2
  ENST ID: ENST00000472139
  CDS Start-End: 137-1051
aaggaataaggccaggtgtggtgtctcatgcctgtaatcccagcactttgggagactgagcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaat

SEQ ID NO: 168998 - DNA, 782 bp, Homo sapiens
  Payload ID: 13266
  Gene Symbol: PSEN2
  Gene Name: presenilin 2
  ENST ID: ENST00000460775
  CDS Start-End: 349-782
atttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtgttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctccc

SEQ ID NO: 168999 - DNA, 734 bp, Homo sapiens
  Payload ID: 13266
  Gene Symbol: PSEN2
  Gene Name: presenilin 2
  ENST ID: ENST00000524196
  CDS Start-End: 672-734
aattttatgcagagctcctggtggctctgaagcgccctagggaacagaccaggaacattctcatggtgttagctcacattgggccattagtgctcctttaatgtgagaacaaccgggaggaggaggggatgtggacccaaaactacaagaaagagtgtcctcgaagcctatgtcctaccgccccacgctgctgccaggcccgcaggaagatgacaggcccggcctccactccttctaaggtcgtcgcttagttccgacgtcgggatgaccctgtcatccacgcggcgtgaaggccaccctccccgcgcgcccgggactccaggcatttccagcagtgaggagacagccagaagcaagcttttggagctgaaggaacctgagacagaagctagtcccccctctgaattttactgatgaagaaactgaggccacagagctaaagtgacttttcccaaggtcgcccagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatg

SEQ ID NO: 169000 - DNA, 627 bp, Homo sapiens
  Payload ID: 13266
  Gene Symbol: PSEN2
  Gene Name: presenilin 2
  ENST ID: ENST00000495488
  CDS Start-End: 241-627
gcgtaaactccgctggagcgcggcggcagagcagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccc

SEQ ID NO: 169001 - DNA, 1972 bp, Homo sapiens
  Payload ID: 13266
  Gene Symbol: PSEN2
  Gene Name: presenilin 2
  ENST ID: ENST00000626989
  CDS Start-End: 1-1446
atgttggcagggactgtcagatttgccaggcattgtttgaagttcttcccagcccagaaacctgcatgtgtagattttggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttgga

SEQ ID NO: 169002 - DNA, 1240 bp, Homo sapiens
  Payload ID: 13267
  Gene Symbol: PARL
  Gene Name: presenilin associated, rhomboid-like
  Uniprot ID: Q9H300
  ENST ID: ENST00000311101
  CDS Start-End: 43-1032
gggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaagtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 169003 - DNA, 1414 bp, Homo sapiens
  Payload ID: 13267
  Gene Symbol: PARL
  Gene Name: presenilin associated, rhomboid-like
  Uniprot ID: Q9H300
  ENST ID: ENST00000317096
  CDS Start-End: 62-1201
ggaagtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcatttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaagcaga

SEQ ID NO: 169004 - DNA, 546 bp, Homo sapiens
  Payload ID: 13267
  Gene Symbol: PARL
  Gene Name: presenilin associated, rhomboid-like
  ENST ID: ENST00000418450
  CDS Start-End: 1-338
ccagcatagtgaacattctgggtcaagagcagttcatggcagtgtacctatctgcaggtgttatttccaattttgtcagttacgtgggtaaagttgccacaggaagatatggaccatcacttggtgcagccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 169005 - DNA, 476 bp, Homo sapiens
  Payload ID: 13267
  Gene Symbol: PARL
  Gene Name: presenilin associated, rhomboid-like
  ENST ID: ENST00000449306
  CDS Start-End: 1-476
acgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggattaacaagtggtggaataacctaagtgatggccagcggactgtgacaggtattatagctgcaaatgtccttgtattctgtttatggagagtaccttctctgcagcggacaatgatcagatatttcacatcgaatccagcctcaagtgttatttccaattttgtcagttacgtgggtaaagttgccacaggaagatatggaccatcacttggtgcatctggtgccatcatgacagtcctcgcagctgtctgcactaagatcccagaagggaggc

SEQ ID NO: 169006 - DNA, 722 bp, Homo sapiens
  Payload ID: 13267
  Gene Symbol: PARL
  Gene Name: presenilin associated, rhomboid-like
  ENST ID: ENST00000417784
  CDS Start-End: 1-514
gcagcggacaatgatcagatatttcacatcgaatccagcctcaacaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 169007 - DNA, 1098 bp, Homo sapiens
  Payload ID: 13267
  Gene Symbol: PARL
  Gene Name: presenilin associated, rhomboid-like
  ENST ID: ENST00000435888
  CDS Start-End: 10-897
gttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaagtgttatttccaattttgtcagttacgtgggtaaagttgccacaggaagatatggaccatcacttggtgcagccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctag

SEQ ID NO: 169008 - DNA, 488 bp, Homo sapiens
  Payload ID: 13267
  Gene Symbol: PARL
  Gene Name: presenilin associated, rhomboid-like
  ENST ID: ENST00000450375
  CDS Start-End: 1-192
cacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcaatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 169009 - DNA, 1347 bp, Homo sapiens
  Payload ID: 13267
  Gene Symbol: PARL
  Gene Name: presenilin associated, rhomboid-like
  ENST ID: ENST00000421484
  CDS Start-End: 63-584
cggaagtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtttgtgttagcttacacgttttaaccattcaagggaagagaaatcaaaccaaaaggtattatagctgcaaatgtccttgtattctgtttatggagagtaccttctctgcagcggacaatgatcagatatttcacatcgaatccagcctcaaaggtcctttgttctccaatgttgctgtcaacattcagtcatttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctccc

SEQ ID NO: 169010 - DNA, 603 bp, Homo sapiens
  Payload ID: 13268
  Gene Symbol: PSENEN
  Gene Name: presenilin enhancer gamma secretase subunit
  Uniprot ID: Q9NZ42
  ENST ID: ENST00000222266
  CDS Start-End: 141-446
agggaaacctggggcgtctcgcgcaaacgtccataactgaaagtagctaaggcaccccagccggaggaagtgagctctcctgggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcga

SEQ ID NO: 169011 - DNA, 1661 bp, Homo sapiens
  Payload ID: 13268
  Gene Symbol: PSENEN
  Gene Name: presenilin enhancer gamma secretase subunit
  Uniprot ID: Q9NZ42
  ENST ID: ENST00000587708
  CDS Start-End: 684-989
ccgggtctcacctggctgaatgtcggcttgttgtgaagccgggagcaccggtccccgtgccggcagaccccgatcttaaagtaaaaagagcagttaaccctggaaaaggtgcaaagacaaaggtgaaccgagggccggggaagctgggcaccccagaaacaccgccccaccacccaggaccccagtaccccggccccgaccccccgagagtccactcccagcgcccgttctcacttgtccttctcagtcccgaatatcgaagctaaatattcagccatttttacccaagccctccaggtctggctgctcttacgtcacttccgttgcttaggagcactgggaagtgtagttcgttgccctctccaggcgcttaccaagcgctcggaaacgccccagggcgcttgcgcgtgggaggcgcgcgccctccccatagactccccggtaggagttcttttaacagcgcatgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcgatactgacttcctgggatcttttagaggttgaggcataaatgattattaatatttaaaaacatctgttgagagctttgtacgaggcttagtatttagacatgatgtacattttttacagtgcatactactcataatcttctgaactaggaactttcctgctcaggaaactattagatgagaaactaagaaaggaatagtgcttccatttctttttcttttttcttttttttttttttttttgagacagagtcttgctctgtcagccaggctggagtgcagtggtaggatcggcctagtgcttccatttctaggggctgttatcctgtactggtagtcgtgaattcaaaaatataactttcctactgtgggctgcagtattctcatcagaagtgtagatcacgatgctacttcctgggatttatctggaccaagacgtgtgacaaatggaagtttcccgttttctgaaggaagtgttgtctgcaaaaataaaaatagtcaagagctttctcagagaa

SEQ ID NO: 169012 - DNA, 833 bp, Homo sapiens
  Payload ID: 13268
  Gene Symbol: PSENEN
  Gene Name: presenilin enhancer gamma secretase subunit
  ENST ID: ENST00000591949
  CDS Start-End: 198-491
aaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctgtgagtctagagcacagaggagggaggccagtggcaggggagagggggaagcggggaatcttggtgggaagggacaatggaggatccaaaatgttggggctctgggtgagaagggaaggctggtctagggaagtctggagagcagccggaggccaacccttccagcttctgtttcccatgacagatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggacc

SEQ ID NO: 169013 - DNA, 587 bp, Homo sapiens
  Payload ID: 13269
  Gene Symbol: PAM16
  Gene Name: presequence translocase-associated motor 16 homolog (S. cerevisiae)
  Uniprot ID: Q9Y3D7
  ENST ID: ENST00000318059
  CDS Start-End: 139-516
ggcaatgcgcatgcccagcgccgtatcgcgcacgcgctctctgcggctttccttgacctctgacccgccgaccacgcttgatccccggccgcggggccaggaagtcggagtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgcattt

SEQ ID NO: 169014 - DNA, 518 bp, Homo sapiens
  Payload ID: 13269
  Gene Symbol: PAM16
  Gene Name: presequence translocase-associated motor 16 homolog (S. cerevisiae)
  ENST ID: ENST00000575848
  CDS Start-End: 37-450
tcacatcttagtgagtccccagggcctctgcggggcatggaatcacacgtgcagtgttccggcatgttcagcctggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 169015 - DNA, 732 bp, Homo sapiens
  Payload ID: 13269
  Gene Symbol: PAM16
  Gene Name: presequence translocase-associated motor 16 homolog (S. cerevisiae)
  ENST ID: ENST00000575636
  CDS Start-End: 109-393
ggcggcctcagggccagggaaaaccgtctgcctggaagaggccgggcaaacgtggtcgcgctgtgcctagcccgcgtgtgagcgagcagccgtgggcagcggtggagcatgagtctggctggccaagtacctggcccagatcattgtgatgggcgtgcaggtggtgggcagggcctttgcacgggccttgcggcaggagtttgcagcctctaccccctaaaaaggaaaccactcctggagaagaggcagctcctagccacctgtccctgtgtctctcatcctgtgctggtggcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 169016 - DNA, 548 bp, Homo sapiens
  Payload ID: 13269
  Gene Symbol: PAM16
  Gene Name: presequence translocase-associated motor 16 homolog (S. cerevisiae)
  ENST ID: ENST00000577031
  CDS Start-End: 32-421
gagtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaagagatcgggtctctccatgttgcccaaactgatctcgaactcctggcctcaagcgatcctcctgccttggcctcccaaaacgctgggactacatgcctgagccaccacgcttggcgaaactgcgtcttttacaggcatcgcctcagatcgcagagctcagaagtggaaaaactatcagatttgccaagaccagctcggtcgggagactaatccggcggcgctagagg

SEQ ID NO: 169017 - DNA, 606 bp, Homo sapiens
  Payload ID: 13269
  Gene Symbol: PAM16
  Gene Name: presequence translocase-associated motor 16 homolog (S. cerevisiae)
  ENST ID: ENST00000571986
  CDS Start-End: 82-267
ctctgacccgccgaccacgcttgatccccggccgcggggccaggaagtcggagtttgagccccggaggcagagcggctgccatggccaagtacctggcccagatcattgtgatgggcgtgcaggtggtgggcagggcctttgcacgggccttgcggcaggagtttgcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 169018 - DNA, 722 bp, Homo sapiens
  Payload ID: 13269
  Gene Symbol: PAM16
  Gene Name: presequence translocase-associated motor 16 homolog (S. cerevisiae)
  ENST ID: ENST00000573553
  CDS Start-End: 217-654
agaattaggacagatctgtttccccgttggtaaagtaaaggttgggcctgatgatctcagaaactcaggaagagtgatggtcggccccagggtcgagagtgagttactgccaggtccagggctgtccctgtgttctggctcccagaccacagtgtttcttcctgaagccggtggttgcagccactttgccttgctcctctacgcctttcctgaaggatgaggtggggccagtctgcctctgggagctcggtcaagttcacccgcctgcctgcctgtccagccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 169019 - DNA, 353 bp, Homo sapiens
  Payload ID: 13269
  Gene Symbol: PAM16
  Gene Name: presequence translocase-associated motor 16 homolog (S. cerevisiae)
  ENST ID: ENST00000571178
  CDS Start-End: 1-179
gatccccggccgcggggccaggaagtcggagtttgagccccggaggcagagcggctgccatgccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgac

SEQ ID NO: 169020 - DNA, 674 bp, Homo sapiens
  Payload ID: 13269
  Gene Symbol: PAM16
  Gene Name: presequence translocase-associated motor 16 homolog (S. cerevisiae)
  ENST ID: ENST00000571941
  CDS Start-End: 169-606
cgtgtttcaagccgaggggaccctctgactttcacctctgtccttcagacagcaccagcatcccatccctgagcctcctgttccactcgggaggggctttaggaaggaggcgaagtcagccggtggttgcagccactttgccttgctcctctacgcctttcctgaaggatgaggtggggccagtctgcctctgggagctcggtcaagttcacccgcctgcctgcctgtccagccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 169021 - DNA, 493 bp, Homo sapiens
  Payload ID: 13269
  Gene Symbol: PAM16
  Gene Name: presequence translocase-associated motor 16 homolog (S. cerevisiae)
  Uniprot ID: Q9Y3D7
  ENST ID: ENST00000576217
  CDS Start-End: 48-425
aatcccagctccttgggagtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 169022 - DNA, 587 bp, Homo sapiens; identical to SEQ ID NO: 169013
  Payload ID: 13269
  Gene Symbol: PAM16
  Gene Name: presequence translocase-associated motor 16 homolog (S. cerevisiae)
  Uniprot ID: Q9Y3D7
  ENST ID: ENST00000616009
  CDS Start-End: 139-516

SEQ ID NO: 169023 - DNA, 606 bp, Homo sapiens; identical to SEQ ID NO: 169017
  Payload ID: 13269
  Gene Symbol: PAM16
  Gene Name: presequence translocase-associated motor 16 homolog (S. cerevisiae)
  ENST ID: ENST00000633650
  CDS Start-End: 82-267

SEQ ID NO: 169024 - DNA, 478 bp, Homo sapiens
  Payload ID: 13269
  Gene Symbol: PAM16
  Gene Name: presequence translocase-associated motor 16 homolog (S. cerevisiae)
  Uniprot ID: Q9Y3D7
  ENST ID: ENST00000634045
  CDS Start-End: 33-410
ggggtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 169025 - DNA, 548 bp, Homo sapiens; identical to SEQ ID NO: 169016
  Payload ID: 13269
  Gene Symbol: PAM16
  Gene Name: presequence translocase-associated motor 16 homolog (S. cerevisiae)
  ENST ID: ENST00000634029
  CDS Start-End: 32-421

SEQ ID NO: 169026 - DNA, 722 bp, Homo sapiens; identical to SEQ ID NO: 169018
  Payload ID: 13269
  Gene Symbol: PAM16
  Gene Name: presequence translocase-associated motor 16 homolog (S. cerevisiae)
  ENST ID: ENST00000631739
  CDS Start-End: 217-654

SEQ ID NO: 169027 - DNA, 674 bp, Homo sapiens; identical to SEQ ID NO: 169020
  Payload ID: 13269
  Gene Symbol: PAM16
  Gene Name: presequence translocase-associated motor 16 homolog (S. cerevisiae)
  ENST ID: ENST00000633831
  CDS Start-End: 169-606

SEQ ID NO: 169028 - DNA, 518 bp, Homo sapiens; identical to SEQ ID NO: 169014
  Payload ID: 13269
  Gene Symbol: PAM16
  Gene Name: presequence translocase-associated motor 16 homolog (S. cerevisiae)
  ENST ID: ENST00000633944
  CDS Start-End: 37-450

SEQ ID NO: 169029 - DNA, 732 bp, Homo sapiens; identical to SEQ ID NO: 169015
  Payload ID: 13269
  Gene Symbol: PAM16
  Gene Name: presequence translocase-associated motor 16 homolog (S. cerevisiae)
  ENST ID: ENST00000631595
  CDS Start-End: 109-393

SEQ ID NO: 169030 - DNA, 353 bp, Homo sapiens; identical to SEQ ID NO: 169019
  Payload ID: 13269
  Gene Symbol: PAM16
  Gene Name: presequence translocase-associated motor 16 homolog (S. cerevisiae)
  ENST ID: ENST00000633558
  CDS Start-End: 1-179

SEQ ID NO: 169031 - DNA, 1618 bp, Homo sapiens
  Payload ID: 13270
  Gene Symbol:
  Gene Name: PRH1-PRR4
  ENST ID: ENST00000536668
  CDS Start-End: 342-1139
tgctggccccggaggccgttagcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccagctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagggagctgacacgtttctcccagcacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcctagatgaggagcgtcagggaccacctttgggaggacagcaatctcaaccctctgctggtgatgggaaccaggatgatggccctcagcagggaccaccccaacaaggaggccagcagcaacaaggtccaccacctcctcagggaaagccacaaggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaa

SEQ ID NO: 169032 - DNA, 1618 bp, Homo sapiens
  Payload ID: 13270
  Gene Symbol:
  Gene Name: PRH1-PRR4
  ENST ID: ENST00000632393
  CDS Start-End: 342-1139
tgctggccccggaggccgttagcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagagttggagtctcactctgttatccaggctggagttcagtggtaggatcatggcttactgcagtctggaactcctgggctcaaaccatcctcccacctcagccttctgctgcagaagaatattttgcctgctggaacctgctgtatctactcaagagtggaagttttcacagggagctgacacgtttctcccagcacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcctagatgaggagcgtcagggaccacctttgggaggacagcaatctcaaccctctgctggtgatgggaaccaggatgatggccctcagcagggaccaccccaacaaggaggccagcagcaacaaggtccaccacctcctcagggaaagccacaaggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaa

SEQ ID NO: 169033 - DNA, 5811 bp, Homo sapiens
  Payload ID: 13271
  Gene Symbol: PRICKLE1
  Gene Name: prickle homolog 1
  Uniprot ID: Q96MT3
  ENST ID: ENST00000345127
  CDS Start-End: 261-2756
catgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaacacttaataaataacaaaactacctttctgaatataaatctttgcaaatgtatccagataacttccattttgtgcctgtgttcaggcatgatttattttgcagttgccctaccattaacagacctccatttgtctcgtgtgtccacacgccccacttgtaggccagaaatagggcttcagacacagaggcttattttttccatatagactggagtggggaaaatttggccttagggaggacagacacaagtccaatgggtaaaccagcgagtagtaggtggacagccgtcccacacaagggtttgtatctgggctacacagattcccttcagaaaagcaccaatggtgagagagttcttcactcagtaacttacattccctggtctggtgcctttaaaaaaccatcagcaatgaaaaggaagtgcatacacatgacaaaaaaattcaaatagggcaaaagtcagagacagcatctcctttccattcttcatcccagtcccccaggtcctctccccagaagtaaccactcttacccagttttagtgtctccttcagacattcaaagcacattcgtataaatgtgtcttttaaaagtggtagtgacctatatgtgctgtgacatgcttttttccctttgtatgtggacatttcacgttagtgcatataggtctacccattctttcagtgactgcttaatagcctactcctaatgatggagttgactttcctcatacattatgctacactggcacatgtgcacataaatcgggagcagcgtagttactgggacaaaggttacgtatttaagactgatggatattgccaattttcctccaaaagaaattctcctgatttacattaatgtaatgtaaatgagagtgtttgttccatcacaacctctcaatgtattagcagatttcttgattttgaagaaattttcagaacctgtgctgccacaagtgggcatccttttagaaaagactgttgcaatatgttgcttataaaggatggataataaatagtaaacaggtgatacttagcctgaagaaatgcaggtataaggtgaaggtactgccctcacttttcaagtacattctcaaaagataggggtaacatagcctgccaaaggcttaaggaaatgcagatatttattcacaataataatgtgactttcttttccttttttttttttttttgagatggagtttcgctcctgttgcccaggctggagcgcaacggcacaatctcagttcactgcaacctctgcctcccgggttcaagcaattctcctgtctcagcctccggagtagctgagattacaggtgcctgccaccatgctcggctaattttttatatttttagtagagacagtgtttcaccaagttggccaggctggtctcgaactcctgaccttcaggtgatccacctgcctcagcctcccaaagtgcaggggattacaggcatgagccactgcgtctggcaataatgtaactttgaagcttaaaaattaatcccagtttgtagcaataacagaagactatctacaacggaagaaagaagcaactgccttacagttctgtaaagaattggcaagaaaataaagcctatagttgccgactt

SEQ ID NO: 169034 - DNA, 4080 bp, Homo sapiens
  Payload ID: 13271
  Gene Symbol: PRICKLE1
  Gene Name: prickle homolog 1
  Uniprot ID: Q96MT3
  ENST ID: ENST00000445766
  CDS Start-End: 131-2626
agaccagcctgtgggattacacgagacaggatcgagtccaaacgggtccccagctcggcaaggcgcgccggaaggaatctaacagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaacacttaataaataacaaaa

SEQ ID NO: 169035 - DNA, 4253 bp, Homo sapiens
  Payload ID: 13271
  Gene Symbol: PRICKLE1
  Gene Name: prickle homolog 1
  Uniprot ID: Q96MT3
  ENST ID: ENST00000455697
  CDS Start-End: 287-2782
acttttgaagatcgccggccccaggcgggctcccggcgctgagcggagacgagtttttctccccgcagaggaggatcctggaaggacgcggagctggggcttgggggatgcagtggcctggacgaggtgactccaacccgggggagcagagtccgtcacgccggcagggaccgagggtctctgcggagctggaggaccttttgtgggatgcctcacggctgctgaggggctgcagcggcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaacacttaataaataacaaaactacctttctgaatata

SEQ ID NO: 169036 - DNA, 456 bp, Homo sapiens
  Payload ID: 13271
  Gene Symbol: PRICKLE1
  Gene Name: prickle homolog 1
  ENST ID: ENST00000547113
  CDS Start-End: 128-456
catgccagcctcgcgcagcctgcgctgacttccccgagacgcgccgcggtcggcacggagactttctgggctctggatgcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactggg

SEQ ID NO: 169037 - DNA, 693 bp, Homo sapiens
  Payload ID: 13271
  Gene Symbol: PRICKLE1
  Gene Name: prickle homolog 1
  ENST ID: ENST00000551050
  CDS Start-End: 337-693
gaggaggggttcgctcgctgcctctgcgtcctgagctcggcctctggctcctggggccggggacgcagagaggggctggagccggtcgacccacggcccagggcgccccctcgcggcctaagcagcggccgccgcctggagcgcagagtttgcggggcccagggggcgccgacgcccgctctgaggcgtctctgctgctgcggcggcggggatggggacgacccaggggaccccctgcagccatcactggcagccccatcaagaattggccggctgagttttcccaaacagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccaga

SEQ ID NO: 169038 - DNA, 585 bp, Homo sapiens
  Payload ID: 13271
  Gene Symbol: PRICKLE1
  Gene Name: prickle homolog 1
  ENST ID: ENST00000552108
  CDS Start-End: 108-585
tatttgcatcttagcggcttcactcactgggctcgggagaatggagcgggcgggcggcgcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttca

SEQ ID NO: 169039 - DNA, 3584 bp, Homo sapiens
  Payload ID: 13271
  Gene Symbol: PRICKLE1
  Gene Name: prickle homolog 1
  Uniprot ID: Q96MT3
  ENST ID: ENST00000548696
  CDS Start-End: 231-2726
tttttctccccgcagaggaggatcctggaaggacgcggagctggggcttgggggatgcagtggcctggacgaggtgactccaacccgggggagcagagtccgtcacgccggcagggaccgagggtctctgcggagctggaggaccttttgtgggatgcctcacggctgctgaggggctgcagcggccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgt

SEQ ID NO: 169040 - DNA, 3324 bp, Homo sapiens
  Payload ID: 13271
  Gene Symbol: PRICKLE1
  Gene Name: prickle homolog 1
  Uniprot ID: Q96MT3
  ENST ID: ENST00000552240
  CDS Start-End: 288-2783
atgtagtggggacccggtgcttgctgccccaccctgctggggtctcctccggaaatgagtgggtgcgggtgactcgtagggcacccagccctctgttccttcgggagtcctccgctcccgctccgggccgccagcctccttcagacgcagagcgggcgggcggctagtgcgcgccgagggctcaggggccggcgccgcgaggggctgcaggccgcgctcggccgctgtccgggccgcagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattg

SEQ ID NO: 169041 - DNA, 8305 bp, Homo sapiens
  Payload ID: 13272
  Gene Symbol: PRICKLE2
  Gene Name: prickle homolog 2
  Uniprot ID: Q7Z3G6
  ENST ID: ENST00000295902
  CDS Start-End: 587-3121
gacttctcaggcaccaccagcagcgccaccgagagttattattattttttgaccaagcagcacatttcctggttcagtggcttgagctctgtgagcagctgactagtcaccccgggtctggctcaggatcagctggtgacgctgggctggagtctatgacttcttccttcagattgtcatgaagaaggggagttaagaggaaactgggggtcctccggaaggcgatctgagcactcaggctgatctagaggaagagtagaagtcatactttttttctcttgcttggtgaattccccagcagagtctggatccagcagtgctgttttccctgagggaatgtggagcagctcggcttgagtctgttgccagcttcaggaagggttcagactgaaaagggggtttgaggagaagatgctttggctgcctgaggtcctgcttgcgttcttagaagtcagatccagggagaaagtgaactgggacaattgacaagctccaagggtctggcagaagcttcctccgagactgggcatttcatcctccctggaggaagatctgcctgcactgcaagtgtccccaggaggagcacatggtgacagtgatgccgctggagatggagaagaccatcagcaaactcatgtttgactttcagaggaactcgacctcagatgatgactcaggctgtgctttggaagagtatgcctgggtcccgccgggtctgaagcctgaacaggtacaccagtactatagctgtctcccagaagagaaagtcccttatgtcaacagtcctggagagaaactgcgaatcaagcagctactacaccagctgccgccacatgacaatgaggttcgatattgcaactccctggatgaggaagagaagagggagctgaagcttttcagcagccagaggaaacgcgaaaacttgggccgcgggaatgtcaggcctttcccagtcaccatgacaggagctatttgtgaacagtgcggaggccagatcaatggtggagacatcgctgtgtttgcgtcacgcgctggccacggcgtttgctggcacccgccgtgcttcgtatgcactgtctgcaatgagctcctggtggatctgatctacttttaccaagatgggaagatatactgtggcaggcaccatgctgagtgcctgaagccgcgctgtgctgcctgcgatgagatcatctttgcagatgaatgcacagaagctgaggggcgacactggcacatgaaacacttttgctgcttcgagtgtgagacagtgctgggcggccagcgctacatcatgaaggagggaagaccctactgttgccactgcttcgagtccttgtatgcagaatattgtgacacctgtgcccaacatataggtatcgaccaaggtcaaatgacctatgatggccaacactggcatgccactgagacctgtttctgctgtgctcactgcaagaaatccctcctggggcggccattcctcccgaagcagggccagatattctgctcacgggcctgcagtgctggggaagaccccaatggttctgactcctctgattccgccttccagaacgccagggccaaggagtcccggcgcagtgccaaaattggcaagaacaagggcaagacggaggagcccatgctgaaccagcacagccagctgcaagtgagttctaaccggctgtcagccgacgtagaccccctgtcactgcagatggacatgctcagcctgtccagccagacacccagcctcaaccgggaccccatctggaggagccgggaagagccctaccattatgggaacaagatggagcagaaccagacccagagccctctgcagctcctcagccagtgcaacatcagaacttcctacagtccaggagggcaaggggctggggcccagcccgaaatgtggggcaagcacttcagcaaccccaaaaggagctcgtcactggccatgacaggacatgctggcagcttcatcaaggaatgccgagaagactattacccggggaggctgagatctcaggagagctacagtgatatgtctagtcagagtttcagtgagacccgaggcagcatccaagtccccaaatatgaggaggaagaggaagaggaagggggcttgtccactcagcagtgtcggacccgtcatcccatcagttccctgaaatacacagaggacatgacgcccacagagcagacccctcggggctccatggaatccctggccctgtctaatgcaacaggcctctctgctgatggtggtgccaagcgccaggagcacctatcccgattttccatgcctgacctcagcaaagactctggaatgaatgtgtctgagaagctgagcaacatgggcactcttaactcgtccatgcagttccggagcgcagagtcagttcgcagcctgctctctgcccagcagtaccaggagatggagggaaacctccaccagctcagcaaccccattggctacagagacctgcagtcccacggaaggatgcatcagagctttgattttgatggagggatggcgggcagcaagctgccagggcaggagggcgtgaggatccagcccatgagtgaacgcacccggagaagagctacttcacgcgacgacaaccgccgtttccgacctcacaggtccaggcgttcccgacgctctcgctccgacaacgccctccacctggccagcgaacgcgaggccatctcccggttaaaagataggccccctctgagagccagggaggactatgaccaatttatgcgccagcggagcttccaggagagcatggggcatgggtcccggagggacctgtacggccagtgccctaggactgtgtcggacctggctttgcagaatgcctttggggaccgctggggaccctacttcgccgagtatgattggtgttccacctgctcctcctcttcagagtctgacaacgagggctatttcctaggagaacccatcccccagccagcgcgcctgcgatacgtcacaagcgatgagctgctgcacaaatacagctcctacggcctccccaaatcttccacattaggtggcagaggacagttgcacagcaggaaaagacagaagagcaaaaactgtatcatttcttaatatgattgggatcagggaatgggagaagatgggagctaagaatgtaaagtcagaaacttgcactgttttaaatgttaaagcgcttttgggggtggcttatgggggagaaaagggaaaatgctgtcagtagatggaggcaaggttacaggttgactcaataggtagtcacagttcttggcatgttgaatattatttgcacatttcactttggaaacacagtagactctatcgaggccaggcttggtcacttccttcccatcagttctgtgttgagttgccatctctcaagatggtaaattgtttcctgctcgcttttatcctctctggttctcttacttttaggacccttttttcagtaagtaatttgtttattagccaggacccaagactaagttatttacatgtccattgtaaatgcaatgtaaatgagagttctgataaaatatttttgtattttgtaatatcaaaggaatttctatatcgtaggactcagtggggacttgcatgcacatccaccattgtctctgagtagtattgaaatgtggcccggtaccaccttttttttttttttttttttttctatacaaatttgttacatgtcagtgagacctttttcaaaggaacatattcaatttggctttttgtggctgaaaaaacataactgttagacccaaagcattttatgctccgttccatcttaaggagccatccttaagtctgctcccaccctcagtagaatttattttctacaaagtggtagtaatttttttttaaattgcaaatgtaatttttgccaattagagaaaccaaccggtgtcagtaaaattctgtgagaaatgccatccctgctgggaatgttgaagttacttaatgttgatctatcccttggggaaagtaaaagtgactgtgagtggtgccattgtgtgatgtcagcatgacgttgttttgaatgtggcattatgttctggtgctcatgtttcctggattgtattatctgctttcctttaccaaggcagacagaactgctgccttagcctgacaaccggttgtcctcaaagcaaatgaacttaagcatttgggattgagggacagaaggattctgagggggctctgcgagggacggtgtgtgacatgtcatgcctggagaaggaacaaggctatttgaaaacagaaggcaggtcaagggtagaagttaaaggagaatctgaaggcaggtcagggaaaagaagaactggaaatgaaacagaggacaggtgacaaccacctcgaagagctcccagagattgtagaaagagtccagtgtaaccagcttagtaaccagagtatctggattacccaggaaggttgagctgctgagatttcagtggtgcaatgtctttaaaaaaacaggctttgttgggagggtatttccattttgaactttgaggactgttggtcagaaaatgggctcaaaagtgagtttgcttaatgaagacatttaacggttgtgctgtttatagtaaaataaaactccctaccttgcttcagttaaaaatgaagcacttggtttcttccatcctcctcctccccttaatggattgtggcagttgaaataatccatcggatgacccacctgtagtgagatgtactgtcgatgtagtgcccggtgtatctcagtggccatctgccatggtgaggtgagcgtgatctcttttcagtatagtagttaacattttctagtattttttatggagagaatgtcaaaagtggcatttcagaccccgtcccagatgggtctgaggaaaggaaggctgtaaaggacatggtaatggcactccattcgggatgtattaaaataatttgcttttcaggtattaatatgacatttgtcattgtcactgatttttttaaaaaagcaatgcacatgttggttgtggctgttttccgcatgctatcttcatatctaaatgcttcattaattatccgagcctccggagaattaactctattacgtttgtatagtaagtttgtaaactgcttggcaaactgattaagaaataatttgcaataccgtgctactaaagtggcaggtttctggtagaaattgtgcgagtccaatttggagttttaagttccttgattgatgaaactaaaaaggcaattttggaaaaagagagggggaaaagtagatcacttatcttagcaaacggttgaaaatatgtctgtcctctgtggccccaaatccagtgaaagaaattctcccagtaaaagttgcttcctaactctgtttttctcagaatacctcttacctttctcaaagaaagcttcaaccaccatcatcagaaagaaggtggcctaaaaactgacacatggccagtgcccggaggggtctggaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtagggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctctgccaatccataccacccttggtactgtgaaaaggcttcttggcagccaggtggcattgaggatggtattcagggcgctttccttctgtcatatagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacaaccaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatctctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttttgcaccttcagggctttaaaatgggctctgcagacagcatttgcatatgcaagactcagtagccaagcctccactgccaattgttgaaggcagtttcagatcgccaccttttgaggtacatttctttaagcacaagagaagtagaaatggcctttgccttgtctccagtggtttgtccctctggtgcctcagcagataccagagcttattcttatgaccatttggaagtagtcctcaaagtaaagatcaagaaaaaattggattctttttccattttctcataatagtagcctagtcaacacaagactcccataaaatatgactcactattgggagccatactattttataagcttacttcctgctgacaaaactagctttcctcaaggaaatataaaggaggggaaagtcacatagtgttaggaaaacattcctgtgttttgaatacgatgaatccataggatagagaaaaatctgcttgttctattctgagagttctctgagatatcccttcactctgcttggcatttggccattgatattcaacaggtcactgaccaagcttttctaaatttttcagagagagttacttaccagtaaggtctgttcttaaacctacctagttgattttcatatctttccataaagtgtcatgattctgtcatagaccctgacttaacattgtaaggactatgagtcctccattttttaattaatttttttttagcaaattaggacttcggcaggttttcctctcctaaactcattctttcctccacaggattgctttgtccatctcctgctttcatttcaagtgcataaacaaaacctcaaagggcctgggaaggtgaggcaggccagagtctgtgttctgtgttgagtgtcaagctatttgttaagaaggtctgcaacaggcctttggtgtgggctctgccagagactgttctgaacactttgcttgagatccgtgccctgtaaaatggatatgatgttttactgatgtctgtaatacatttgtaaacttccaataaaatttgaataaaagaaa

SEQ ID NO: 169042 - DNA, 573 bp, Homo sapiens
  Payload ID: 13272
  Gene Symbol: PRICKLE2
  Gene Name: prickle homolog 2
  ENST ID: ENST00000498162
  CDS Start-End: 122-573
aaccccctttccccggctcccccgcagtttcccgggccggcagaggcgccgcagcgtcggagcaatgcaaggctaagccgggaagatctgcctgcactgcaagtgtccccaggaggagcacatggtgacagtgatgccgctggagatggagaagaccatcagcaaactcatgtttgactttcagaggaactcgacctcagatgatgactcaggctgtgctttggaagagtatgcctgggtcccgccgggtctgaagcctgaacaggtacaccagtactatagctgtctcccagaagagaaagtcccttatgtcaacagtcctggagagaaactgcgaatcaagcagctactacaccagctgccgccacatgacaatgaggttcgatattgcaactccctggatgaggaagagaagagggagctgaagcttttcagcagccagaggaaacgcgaaaacttgggccgcgggaatgtcaggcctttcccagtcaccatgacaggagctatttgtgaacagtgcggaggccagatcaatggtggagacatcgctgtgtttgcgtcacgcgctggcca

SEQ ID NO: 169043 - DNA, 4242 bp, Homo sapiens
  Payload ID: 13272
  Gene Symbol: PRICKLE2
  Gene Name: prickle homolog 2
  ENST ID: ENST00000564377
  CDS Start-End: 11-2713
gcgtccggccatgttcagccggagctcccggaaaagactctccagccgctcgttgaccggactggggcggatagagcgaggccagccatgtaacgcctgtggtgaccagtgccctgggttcgccttgcataaatggaggaagatctgcctgcactgcaagtgtccccaggaggagcacatggtgacagtgatgccgctggagatggagaagaccatcagcaaactcatgtttgactttcagaggaactcgacctcagatgatgactcaggctgtgctttggaagagtatgcctgggtcccgccgggtctgaagcctgaacaggtacaccagtactatagctgtctcccagaagagaaagtcccttatgtcaacagtcctggagagaaactgcgaatcaagcagctactacaccagctgccgccacatgacaatgaggttcgatattgcaactccctggatgaggaagagaagagggagctgaagcttttcagcagccagaggaaacgcgaaaacttgggccgcgggaatgtcaggcctttcccagtcaccatgacaggagctatttgtgaacagtgcggaggccagatcaatggtggagacatcgctgtgtttgcgtcacgcgctggccacggcgtttgctggcacccgccgtgcttcgtatgcactgtctgcaatgagctcctggtggatctgatctacttttaccaagatgggaagatatactgtggcaggcaccatgctgagtgcctgaagccgcgctgtgctgcctgcgatgagatcatctttgcagatgaatgcacagaagctgaggggcgacactggcacatgaaacacttttgctgcttcgagtgtgagacagtgctgggcggccagcgctacatcatgaaggagggaagaccctactgttgccactgcttcgagtccttgtatgcagaatattgtgacacctgtgcccaacatataggtatcgaccaaggtcaaatgacctatgatggccaacactggcatgccactgagacctgtttctgctgtgctcactgcaagaaatccctcctggggcggccattcctcccgaagcagggccagatattctgctcacgggcctgcagtgctggggaagaccccaatggttctgactcctctgattccgccttccagaacgccagggccaaggagtcccggcgcagtgccaaaattggcaagaacaagggcaagacggaggagcccatgctgaaccagcacagccagctgcaagtgagttctaaccggctgtcagccgacgtagaccccctgtcactgcagatggacatgctcagcctgtccagccagacacccagcctcaaccgggaccccatctggaggagccgggaagagccctaccattatgggaacaagatggagcagaaccagacccagagccctctgcagctcctcagccagtgcaacatcagaacttcctacagtccaggagggcaaggggctggggcccagcccgaaatgtggggcaagcacttcagcaaccccaaaaggagctcgtcactggccatgacaggacatgctggcagcttcatcaaggaatgccgagaagactattacccggggaggctgagatctcaggagagctacagtgatatgtctagtcagagtttcagtgagacccgaggcagcatccaagtccccaaatatgaggaggaagaggaagaggaagggggcttgtccactcagcagtgtcggacccgtcatcccatcagttccctgaaatacacagaggacatgacgcccacagagcagacccctcggggctccatggaatccctggccctgtctaatgcaacaggcctctctgctgatggtggtgccaagcgccaggagcacctatcccgattttccatgcctgacctcagcaaagactctggaatgaatgtgtctgagaagctgagcaacatgggcactcttaactcgtccatgcagttccggagcgcagagtcagttcgcagcctgctctctgcccagcagtaccaggagatggagggaaacctccaccagctcagcaaccccattggctacagagacctgcagtcccacggaaggatgcatcagagctttgattttgatggagggatggcgggcagcaagctgccagggcaggagggcgtgaggatccagcccatgagtgaacgcacccggagaagagctacttcacgcgacgacaaccgccgtttccgacctcacaggtccaggcgttcccgacgctctcgctccgacaacgccctccacctggccagcgaacgcgaggccatctcccggttaaaagataggccccctctgagagccagggaggactatgaccaatttatgcgccagcggagcttccaggagagcatggggcatgggtcccggagggacctgtacggccagtgccctaggactgtgtcggacctggctttgcagaatgcctttggggaccgctggggaccctacttcgccgagtatgattggtgttccacctgctcctcctcttcagagtctgacaacgagggctatttcctaggagaacccatcccccagccagcgcgcctgcgatacgtcacaagcgatgagctgctgcacaaatacagctcctacggcctccccaaatcttccacattaggtggcagaggacagttgcacagcaggaaaagacagaagagcaaaaactgtatcatttcttaatatgattgggatcagggaatgggagaagatgggagctaagaatgtaaagtcagaaacttgcactgttttaaatgttaaagcgcttttgggggtggcttatgggggagaaaagggaaaatgctgtcagtagatggaggcaaggttacaggttgactcaataggtagtcacagttcttggcatgttgaatattatttgcacatttcactttggaaacacagtagactctatcgaggccaggcttggtcacttccttcccatcagttctgtgttgagttgccatctctcaagatggtaaattgtttcctgctcgcttttatcctctctggttctcttacttttaggacccttttttcagtaagtaatttgtttattagccaggacccaagactaagttatttacatgtccattgtaaatgcaatgtaaatgagagttctgataaaatatttttgtattttgtaatatcaaaggaatttctatatcgtaggactcagtggggacttgcatgcacatccaccattgtctctgagtagtattgaaatgtggcccggtaccaccttttttttttttttttttttttctatacaaatttgttacatgtcagtgagacctttttcaaaggaacatattcaatttggctttttgtggctgaaaaaacataactgttagacccaaagcattttatgctccgttccatcttaaggagccatccttaagtctgctcccaccctcagtagaatttattttctacaaagtggtagtaatttttttttaaattgcaaatgtaatttttgccaattagagaaaccaaccggtgtcagtaaaattctgtgagaaatgccatccctgctgggaatgttgaagttacttaatgttgatctatcccttggggaaagtaaaagtgactgtgagtggtgccattgtgtgatgtcagcatgacgttgttttgaatgtggcattatgttctggtgctcatgtttcctggattgtattatctgctttcctttaccaaggcagacagaactgctgccttagcctgacaaccggttgtcctcaaagcaaatgaacttaagcatttgggattgagggacagaaggattctgagggggctctgcgagggacggtgtgtgacatgtcatgcctggagaaggaacaaggctatttgaaaacagaaggcaggtcaagggtagaagttaaaggagaatctgaaggcaggtcagggaaaagaagaactggaaatgaaacagaggacaggtgacaaccacctcgaagagctcccagagattgtagaaagagtccagtgtaaccagcttagtaaccagagtatctggattacccaggaaggttgagctgctgagatttcagtggtgcaatgtctttaaaaaaacaggctttgttgggagggtatttccattttgaactttgaggactgttggtcagaaaatgggctcaaaagtgagtttgcttaatgaagacatttaacggttgtgctgtttatagtaaaataaaactccctaccttgcttcagtt

SEQ ID NO: 169044 - DNA, 524 bp, Homo sapiens
  Payload ID: 13272
  Gene Symbol: PRICKLE2
  Gene Name: prickle homolog 2
  ENST ID: ENST00000569824
  CDS Start-End: 105-524
agccaggccagcggccgccgagggtgcccgcccaggctacccgccctcccggccgcggcgcggacggaccgacggacggcgctgcgagcaggaggcgtccggccatgttcagccggagctcccggaaaagactctccagccgctcggtgagtgtcccccgctcgagcggggccgatcgccgggcacctccagccggccgcgagcgcccgcgcgcagccccactgcgccccgcggctgcgcacctgtggccccagttgaccggactggggcggatagagcgaggccagccatgtaacgcctgtggtgaccagtgccctgggttcgccttgcataaatggaggaagatctgcctgcactgcaagtgtccccaggaggagcacatggtgacagtgatgccgctggagatggagaagaccatcagcaaactcatgtttgactttcagaggaactcgacctcagatgatgactcaggctgtgctttggaagagtatgcctgggtcccgccgggtctgaagcctgaacag

SEQ ID NO: 169045 - DNA, 574 bp, Homo sapiens
  Payload ID: 13273
  Gene Symbol: PRICKLE3
  Gene Name: prickle homolog 3
  ENST ID: ENST00000376317
  CDS Start-End: 232-574
agaggcctttcccgcggggcactccgggctacgtgcagttcacctctaggcagggggcgccctggcagcggagagaccacatgcccgggggcgggccctgcggggcgcgctcctcccacgagggtgtcaggtttacggaaccgagttcccaggccggacgcgcggtggcctgacggtcgcaaggattacattcgcctgacccggcccggcttgaccctgcccgggcgcgccatgttcgcgcgtgggtcccggaggcgccgctccgggcgtgcgcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcagttgttttctcccactcctatgtcctcccagg

SEQ ID NO: 169046 - DNA, 1937 bp, Homo sapiens
  Payload ID: 13273
  Gene Symbol: PRICKLE3
  Gene Name: prickle homolog 3
  ENST ID: ENST00000453382
  CDS Start-End: 242-1885
agtggaggggcgggcgttgacttctccttccctgcttccgcgcctcacccggccctgcatctgcccccgcccactgcagcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgag

SEQ ID NO: 169047 - DNA, 990 bp, Homo sapiens
  Payload ID: 13273
  Gene Symbol: PRICKLE3
  Gene Name: prickle homolog 3
  ENST ID: ENST00000432913
  CDS Start-End: 236-990
cccgcctctgcctcggttgtgtcccgctcccccgcactctgggcgctgtcccagcctgcccagcgctgcccagcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggtgg

SEQ ID NO: 169048 - DNA, 2246 bp, Homo sapiens
  Payload ID: 13273
  Gene Symbol: PRICKLE3
  Gene Name: prickle homolog 3
  ENST ID: ENST00000540849
  CDS Start-End: 231-527
ctctgcctcggttgtgtcccgctcccccgcactctgggcgctgtcccagcctgcccagcgctgcccagcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtgaccagaggccagccctccactcttgctgtccagtgggtgcacactaatgctcacacacacacacacacactcaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatgcccctcacccccacgccccgcccctacaacctaagtcataaatcctcttcctccctcctttatcagtttgtttctatttttgtttctgttttagagacttggtctaccctattgcccaggctggagtgcagtggtgtgatcagggctcactgcagcctcaaaagttttgggctcaagctatcctcccacctcagcctcccaagtagctgggactccaggctcgtgtcagcgttcccagctaattttttaattttttggtagagatggggttttgccatgttgcccaggctggtctagaactcctgggctcaagcaatcctcccgcagcctcccaaaggactgggattaca

SEQ ID NO: 169049 - DNA, 2062 bp, Homo sapiens
  Payload ID: 13273
  Gene Symbol: PRICKLE3
  Gene Name: prickle homolog 3
  Uniprot ID: O43900
  ENST ID: ENST00000599218
  CDS Start-End: 96-1943
ggaaccgagttcccaggccggacgcgcggtggcctgacggtcgcaaggattacattcgcctgacccggcccggcttgaccctgcccgggcgcgccatgttcgcgcgtgggtcccggaggcgccgctccgggcgtgcgcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatgcccctcacccccacgccccgcccctacaacctaagtcataaatcctcttcctccctcctt

SEQ ID NO: 169050 - DNA, 2871 bp, Homo sapiens
  Payload ID: 13274
  Gene Symbol: PRICKLE4
  Gene Name: prickle homolog 4
  Uniprot ID: Q2TBC4
  ENST ID: ENST00000335515
  CDS Start-End: 588-1742
aaaaactctggggatctatcgagagggcagttggcgggactgggcactccccttccttctccctcccactgtccccagaaatcttcccatccctccacctccccaagccctaagtcctctcgggctctgcccttcagggcagcgggtgttggggatgtccagctcctgagccctcttgcacggaggctctgcacggaggcaagacaaggggttcagctctgtcccttatctgaggtgggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggca

SEQ ID NO: 169051 - DNA, 2098 bp, Homo sapiens
  Payload ID: 13274
  Gene Symbol: PRICKLE4
  Gene Name: prickle homolog 4
  Uniprot ID: Q2TBC4
  ENST ID: ENST00000359201
  CDS Start-End: 821-1855
tggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcaggtagtagagtcgtgcccttcctctgagaccaacatgtcctctatcctgtggagtggccacccttttccaccaacccggaggtagtttgacttcgtgcctaatctcttgttgcctttttctcttttcaggaattcctgtctctgcacctgcttagaacatggggttttgactttaaactcattcacatgagtattcattatctctcctagggggtctgtattgtcaaaccagactctaggggctttggccccaaggcgtgaagggggttaagaagggaaagcataagaagggaagctgttttggggtgtggggcctccccagcctccctcaaggaagaccacacatgcaggcatcagtcagctatccttgcactcagtgaggatctgcaaggaggaccctcccaaatggagggcatgcttagaagctgctctagattggagaagaggtggcaatgatgagggggaaagaaggagaaaggaaagaaaaacctagtttcactcctccccttcttccatgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccct

SEQ ID NO: 169052 - DNA, 939 bp, Homo sapiens
  Payload ID: 13274
  Gene Symbol: PRICKLE4
  Gene Name: prickle homolog 4
  ENST ID: ENST00000394259
  CDS Start-End: 1-939
atgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtag

SEQ ID NO: 169053 - DNA, 1035 bp, Homo sapiens
  Payload ID: 13274
  Gene Symbol: PRICKLE4
  Gene Name: prickle homolog 4
  ENST ID: ENST00000394260
  CDS Start-End: 1-1035
atgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctag

SEQ ID NO: 169054 - DNA, 1155 bp, Homo sapiens
  Payload ID: 13274
  Gene Symbol: PRICKLE4
  Gene Name: prickle homolog 4
  ENST ID: ENST00000394263
  CDS Start-End: 1-1155
atgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctag

SEQ ID NO: 169055 - DNA, 3947 bp, Homo sapiens
  Payload ID: 13274
  Gene Symbol: PRICKLE4
  Gene Name: prickle homolog 4
  ENST ID: ENST00000456057
  CDS Start-End: 662-874
cggggctgggagaccacagggagagtttggggagacctgggaactgcggagagacagggctgcgggcccggcgaggcgtttccattcagcgaatggttgaaaacccagcgtaaacgcggctcccggcgtctgctggatgcctgccgggcgcagtccgagccagagagcccttgcacctgcatggcagaggccatggagcccgcacatttccaccctgagatcccataaatgtggttttgttttccttttttttttcctccccccaatctgcagctccaggcccctccctgagccgcccctctccaccagccggggaggggcgggcgggggccgctggggcgtgggagaggaagggccgcgctattagggcgggcgggggcggacgggggcgggcgctgaagccttggggtggggaccgggtgaggggcctgacggcagagtcggtccagaactgcccggacagcgacgcacagcgaggagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcaggaattcctgtctctgcacctgcttagaacatggggttttgactttaaactcattcacatgagtattcattatctctcctagggggtctgtattgtcaaaccagactctaggggctttggccccaaggcgtgaagggggttaagaagggaaagcataagaagggaagctgttttggggtgtggggcctccccagcctccctcaaggaagaccacacatgcaggcatcagtcagctatccttgcactcagtgaggatctgcaaggaggaccctcccaaatggagggcatgcttagaagctgctctagattggagaagaggtggcaatgatgagggggaaagaaggagaaaggaaagaaaaacctagtttcactcctccccttcttccatgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaat

SEQ ID NO: 169056 - DNA, 1646 bp, Homo sapiens
  Payload ID: 13274
  Gene Symbol: PRICKLE4
  Gene Name: prickle homolog 4
  Uniprot ID: Q2TBC4
  ENST ID: ENST00000458694
  CDS Start-End: 249-1403
gaccgggtgaggggcctgacggcagagtcggtccagaactgcccggacagcgacgcacagcgaggagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccct

SEQ ID NO: 169057 - DNA, 880 bp, Homo sapiens
  Payload ID: 13274
  Gene Symbol: PRICKLE4
  Gene Name: prickle homolog 4
  ENST ID: ENST00000483200
  CDS Start-End: 1-844
ggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggtaagggagaggatgcagagcaaagcgggagggagcttgggctgggctgtgggggttctcccgggctgggaccctcgccccggtcccacgccgtcccgtccctccaggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagacca

SEQ ID NO: 169058 - DNA, 746 bp, Homo sapiens
  Payload ID: 13275
  Gene Symbol: PIFO
  Gene Name: primary cilia formation
  Uniprot ID: Q8TCI5
  ENST ID: ENST00000369737
  CDS Start-End: 34-510
gcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatgaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctgggtctgtgggtttctgttggg

SEQ ID NO: 169059 - DNA, 2627 bp, Homo sapiens
  Payload ID: 13275
  Gene Symbol: PIFO
  Gene Name: primary cilia formation
  Uniprot ID: Q8TCI5
  ENST ID: ENST00000369738
  CDS Start-End: 366-941
ccttacttgctggtggcccagacttcgggacattctgaacctcactgtccttccctctacaacagcgcattcctcttggcccagcttccaaagctatttgccgccccgtcaaccctgcagcccctacagccgcgaatccaggaaaccctctacccgcagcccagctactgagtttacaatcccctgggctttgggctccaaggtgcgggttcctgccccagtagtggctcggtggacgccccaacttgccgcgcaggcgcgctcgggccctctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctgggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctcccaattgtgttgctcagtgtggagtgggaaggtcttgatttggttgactttcccagattgacataaaactcaaaaaccaaaaaattgcccctttcctatgacatcatccatttagtctgtgagtcaacatatatactgaggtcctactatgtgttgagcagagcagtaagcactggggatatggcaggaatcaaaataaacttatctactaagtccttgggcctggcctgaagtcagaggaggactccccagggcagctaggggattgggtctgccctccaatctgaatgaccccctagaaccttacaagtcattctggggttataaagatcataacatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagacgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacgaa

SEQ ID NO: 169060 - DNA, 2289 bp, Homo sapiens
  Payload ID: 13276
  Gene Symbol: PRIMPOL
  Gene Name: primase and polymerase (DNA-directed)
  Uniprot ID: Q96LW4
  ENST ID: ENST00000314970
  CDS Start-End: 434-2116
gcgccccgcccccgcgccccgcgtcctcacgccctggtcccgccctcgcgtcccgcgccagtcctcccgctttggtcccgccctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaa

SEQ ID NO: 169061 - DNA, 2168 bp, Homo sapiens
  Payload ID: 13276
  Gene Symbol: PRIMPOL
  Gene Name: primase and polymerase (DNA-directed)
  Uniprot ID: Q96LW4
  ENST ID: ENST00000503752
  CDS Start-End: 349-2031
ctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctg

SEQ ID NO: 169062 - DNA, 2007 bp, Homo sapiens
  Payload ID: 13276
  Gene Symbol: PRIMPOL
  Gene Name: primase and polymerase (DNA-directed)
  ENST ID: ENST00000515774
  CDS Start-End: 528-1823
gcgccagtcctcccgctttggtcccgccctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccaggacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaattcaggagaaa

SEQ ID NO: 169063 - DNA, 784 bp, Homo sapiens
  Payload ID: 13276
  Gene Symbol: PRIMPOL
  Gene Name: primase and polymerase (DNA-directed)
  ENST ID: ENST00000515152
  CDS Start-End: 263-601
ctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttcccc

SEQ ID NO: 169064 - DNA, 1631 bp, Homo sapiens
  Payload ID: 13276
  Gene Symbol: PRIMPOL
  Gene Name: primase and polymerase (DNA-directed)
  ENST ID: ENST00000509002
  CDS Start-End: 309-590
gtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccaggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcgaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaa

SEQ ID NO: 169065 - DNA, 1138 bp, Homo sapiens
  Payload ID: 13276
  Gene Symbol: PRIMPOL
  Gene Name: primase and polymerase (DNA-directed)
  ENST ID: ENST00000506278
  CDS Start-End: 270-608
gattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagc

SEQ ID NO: 169066 - DNA, 518 bp, Homo sapiens
  Payload ID: 13276
  Gene Symbol: PRIMPOL
  Gene Name: primase and polymerase (DNA-directed)
  ENST ID: ENST00000508001
  CDS Start-End: 1-518
aaattggaaagcgtgtggctttggaggttactgaagataacaaattttttcctatacagtcaaaagatgtttctgacgaatatcaatattttctctcttctttggtcagcaatgtcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatc

SEQ ID NO: 169067 - DNA, 2174 bp, Homo sapiens
  Payload ID: 13276
  Gene Symbol: PRIMPOL
  Gene Name: primase and polymerase (DNA-directed)
  ENST ID: ENST00000512834
  CDS Start-End: 322-2001
atttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaa

SEQ ID NO: 169068 - DNA, 1393 bp, Homo sapiens
  Payload ID: 13277
  Gene Symbol: PRIM1
  Gene Name: primase, DNA, polypeptide 1 (49kDa)
  Uniprot ID: P49642
  ENST ID: ENST00000338193
  CDS Start-End: 38-1300
cctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatatctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactata

SEQ ID NO: 169069 - DNA, 1459 bp, Homo sapiens
  Payload ID: 13277
  Gene Symbol: PRIM1
  Gene Name: primase, DNA, polypeptide 1 (49kDa)
  ENST ID: ENST00000552590
  CDS Start-End: 76-633
cagtcgcggggccgccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaagggcaagactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatatctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactatatatgtgtcttaaacctcaaagtaaat

SEQ ID NO: 169070 - DNA, 456 bp, Homo sapiens
  Payload ID: 13277
  Gene Symbol: PRIM1
  Gene Name: primase, DNA, polypeptide 1 (49kDa)
  ENST ID: ENST00000549549
  CDS Start-End: 1-456
agaaaatctataaacataataaaaaaatactttgaagaatatgccttggttaatcaagatattctcgaaaataaagaaagctgggataagattttagcccttgttcctgaaaaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatatctgtgcctattgatttgcagaaagtggaccagtttgatccatttactgttccgaccataagcttcatctgccgtgaattggatgccatttccactaatgaagaggaaaaagaggagaatgaa

SEQ ID NO: 169071 - DNA, 1008 bp, Homo sapiens
  Payload ID: 13277
  Gene Symbol: PRIM1
  Gene Name: primase, DNA, polypeptide 1 (49kDa)
  ENST ID: ENST00000550770
  CDS Start-End: 26-1008
cttaccgtggcgagttccgcgctcaatggagacgtttgaccccaccgagctgcccgagctgcttaaactttattaccggaggctctttccctactctcagtactatcgctggctcaactacggtggaggtgatggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcc

SEQ ID NO: 169072 - DNA, 909 bp, Homo sapiens
  Payload ID: 13278
  Gene Symbol: PRIM2
  Gene Name: primase, DNA, polypeptide 2 (58kDa)
  Uniprot ID: P49643
  ENST ID: ENST00000370687
  CDS Start-End: 126-602
gatttactgaacatggctgctgaaatgtataacattattgtgcattattgctaccgtgatatgcggatttatattgcaattgcctctggattcagaaaaacacccttcacagtgaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctgtaagtatatttttgtagttatttctaattgttctcaccattcatttttcccttctgtcttaagtgctggtactaatgtgtagtgtgttctctttacattctccaagtacctgcctgaaacagtagctaatagctttggataacaatatatctttccttctctatgactagaagaaaaggactccttaataacaaagtctcacacttacttgctctgttaaatgtgtgctttattaaagcacaagaaggtttagtttataaaggttcatctttaaccaaaattttgtcggccaaaataaagctaataatgtgttaaactagacaa

SEQ ID NO: 169073 - DNA, 2308 bp, Homo sapiens
  Payload ID: 13278
  Gene Symbol: PRIM2
  Gene Name: primase, DNA, polypeptide 2 (58kDa)
  Uniprot ID: P49643
  ENST ID: ENST00000615550
  CDS Start-End: 88-1617
ggtttcatatgaactctcccgccacccgggaacagtggctgccaccgtttgtgttttcccgagtttgaattcttgcaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcattaacagccaggtccttgcctgctgtgcagtctgatgaaagacttcagcctctgctcaatcacctcagtcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaagtttgataaaggttactcttacaacatccgtcacagctttggaaaggaaggcaagaggacagactatacacctttcagttgcctgaagattattctgtccaatccaccaagccaaggggattatcatgggtgcccattccgtcacagtgatccagagctgctgaagcaaaagttgcagtcatacaagatctctcctggagggataagccagattttggatttagtaaaggggacacattaccaggtagcctgtcaaaaatactttgagatgatacacaatgtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgtttcctgtttttaagattttgcctttgttgttgaaaaagggtttcactctgtcaccaaggcttagtgcagtgacacaattacagctgattgcagccttgaccttcccagctcaagtgatcctcctacctcagcctcccaagtagttaggaccacaggtgtgcacctcatatccagataatttttttcaatttttttttgtagaggtggggggtctccctatgttgcccaggcagatctcagactcctgggctcaagcgatcctcacacctcagcgtcccagagtgctgggattacggttgtgagccactgtgcctggccttttttttttttttaacctttttgtttaacttctctcttcactgcatcccaatccatctacaggcatgcacacttattaggaaaggaggtttgaggtaacaacagagactttcactatattttgctttgacagaaggaaagaggaggagtttctattaaaatctgtcacttgagtgatgtcatttaagtcctattttaggagataaaaacagctttggggactggttaaagtcccccagaaactacaataaagaacaacttttgttttaactcttaatcactttgtaattttgactcaatccttttctggaccatttttgttaataaatatcaaagtgt

SEQ ID NO: 169074 - DNA, 864 bp, Homo sapiens
  Payload ID: 13278
  Gene Symbol: PRIM2
  Gene Name: primase, DNA, polypeptide 2 (58kDa)
  Uniprot ID: P49643
  ENST ID: ENST00000274891
  CDS Start-End: 88-564
ggtttcatatgaactctcccgccacccgggaacagtggctgccaccgtttgtgttttcccgagtttgaattcttgcaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctgtaagtatatttttgtagttatttctaattgttctcaccattcatttttcccttctgtcttaagtgctggtactaatgtgtagtgtgttctctttacattctccaagtacctgcctgaaacagtagctaatagctttggataacaatatatctttccttctctatgactagaagaaaaggactccttaataacaaagtctcacacttacttgctctgttaaatgtgtgctttattaaagcacaagaaggtttagtttataaaggttcatctttaaccaaaattttgtcggccaaaataaagctaataatgtgttaaac

SEQ ID NO: 169075 - DNA, 375 bp, Homo sapiens
  Payload ID: 13278
  Gene Symbol: PRIM2
  Gene Name: primase, DNA, polypeptide 2 (58kDa)
  ENST ID: ENST00000550475
  CDS Start-End: 1-280
tcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaaggaagaggaaaatgatgaatagtagaagctccgcctgtgaagataattttacctgcagctgaaataccatgacccagatattgaacacacagaataattaaacttttcgtctagaaa

SEQ ID NO: 169076 - DNA, 2657 bp, Homo sapiens
  Payload ID: 13279
  Gene Symbol: PRNP
  Gene Name: prion protein
  Uniprot ID: P04156
  ENST ID: ENST00000379440
  CDS Start-End: 288-1049
gaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacc

SEQ ID NO: 169077 - DNA, 2539 bp, Homo sapiens
  Payload ID: 13279
  Gene Symbol: PRNP
  Gene Name: prion protein
  Uniprot ID: P04156
  ENST ID: ENST00000430350
  CDS Start-End: 170-931
cgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacc

SEQ ID NO: 169078 - DNA, 806 bp, Homo sapiens
  Payload ID: 13279
  Gene Symbol: PRNP
  Gene Name: prion protein
  ENST ID: ENST00000424424
  CDS Start-End: 60-806
agtcgctgacagccgcggcgccgcgagcttctcctctcctcacgaccgaggcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttc

SEQ ID NO: 169079 - DNA, 855 bp, Homo sapiens
  Payload ID: 13279
  Gene Symbol: PRNP
  Gene Name: prion protein
  ENST ID: ENST00000457586
  CDS Start-End: 205-855
gggggcaggggagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccag

SEQ ID NO: 169080 - DNA, 2333 bp, Homo sapiens
  Payload ID: 13280
  Gene Symbol: PRNT
  Gene Name: prion protein (testis specific)
  Uniprot ID: Q86SH4
  ENST ID: ENST00000326539
  CDS Start-End: 939-1223
gtccctagagacagcctggaaagattgggtgccagctgcagagaggagagcaaggcgaccaaacgcagggtaaggtctggaggtgctcatagttcactacgggacatgtacatggaagtgaataattatgtcacaaggtgccaagggggctagttacctcacataggatcttagaaaaggtctcctggagaccatgtctgagctggtcctgaggtgtgagtagggattctccgcagggcggggaaggacttgaaagagtctggcaatatggagcacatcaggattatggaaggtgagcttggagaacaaggcagagtctagcctgtgaaaggcctcttgcaatttgttgaggatccatgaccttctcccatgcatggtgaaatgcccttaaaggattttgaatagatttaaaagacactcaaaaacaaaaaacggtagattcaaaatagacggtagggatcgctttcttccgttttctttgaaggatcagaagtgtttaccaccacctggattgtttttgggctttcagctgtggctgcctgcagcccatcctgcccccagcacctagagtcatctttagaaatgcaagcctgatcgtggaatccaccttcctaacacccttcagtgccctcctcttcgttacacccttactatacaaacgatagtccatggaccagcagcatcaacataaccagggagcttgttagaaatgtagaatctggtccatcccaaacctgacgaagcagaagctgcattttgccaagatcccagggaatttgtgtgcccgttatggtttgcgaagtgcttcccaagagaacatacggcaagccagagggatctttgcagatcttgctcctttcattctctggcctcatcttgtcgctctcctccatccgtgcccacatccccactgtactggaccgcttgcagctccttgaatgcagcatagtcttgttttcttttttgcagtgattctacatctttcccatcttctccacctggatgcctccatccatcctttcagacttcccttctctagcaaacctttcttgctaattcccatgtctaacacaacacttccccatactgcatggccattatcctttctgcatcagactgtgagcaccttgaaggcagtggcagtgactcattcattgtggcatctgcagattccagtggactgccaggcatgcaatagaaaatcaaaaaagatttactgctaaataatcctcaactccagtggcagctccatgtgccatttctcttccgctctggcctcggctcttcctgtgcctacctggggcttggctttcacctaggtgtctgcatggaagggagagcgacctggaggaccatcgccaatccatcaatagcctcccggttgagatgacttcagctctgatttggaagagctatgatattgtttataggagtgaattaatatgtgtaaaggttacaaagtaaacagttaaattaaattaattgtgctggagcaggtcaaacaggcttctgagagatgaacatacacatctctattaactccacattcagtgagtgtgggtaacttgaaattggctgggtcaccatttacatcatagaaattggcaaatagtacaaattagggctccctcacccctactcgggcatagagctggtacactagcacacctctggttatacatgcatgcgtgtgccaccagaacaaaacacctaacagcaggcacgttgcctctgttgcccaccattacagctcccgcacggagcagacagactcatggcaggaattgaatgcatgtttgtcgagtggaagcatgaacaaatccacaaaatgcccaagatgaggcaaagaaggacattggctcaaatgttaaacataagttaggagctgagataatgcccagaggaaaaatgttctgtaattctaagtaaaacccatctctaaggcaggatgctgcttatgagggctccacagacagatgggggaggcctgggtcctgcccttggaaagagtctgacagctcgacttctggaaacagccatctgcacaggtcaacatcttcttagctgacagggagcagatttgcagaccacatcacatttgaaattccagaagaaacttcttggagtctgctcttgtgcaaatgagcctagaaagcccgttaactttgggtggaggcttccactgtttggctatcccaagtgggcccaaagctaaggaaaacccaccagccctttgcttcctgcttcctctatttgtttgccccaggaaatcagaggtgatgacatgatttggcttgggcacgacaggaataaacgatatttaagagacgtca

SEQ ID NO: 169081 - DNA, 2096 bp, Homo sapiens
  Payload ID: 13280
  Gene Symbol: PRNT
  Gene Name: prion protein (testis specific)
  Uniprot ID: Q86SH4
  ENST ID: ENST00000423718
  CDS Start-End: 702-986
gtccctagagacagcctggaaagattgggtgccagctgcagagaggagagcaaggcgaccaaacgcagggtaaggtctggaggtgctcatagttcactacgggacatgtacatggaagtgaataattatgtcacaaggtgccaagggggctagttacctcacataggatcttagaaaaggtctcctggagaccatgtctgagctggtcctgaggtgtgagtagggattctccgcagggcggggaaggacttgaaagagtctggcaatatggagcacatcaggattatggaagctgtggctgcctgcagcccatcctgcccccagcacctagagtcatctttagaaatgcaagcctgatcgtggaatccaccttcctaacacccttcagtgccctcctcttcgttacacccttactatacaaacgatagtccatggaccagcagcatcaacataaccagggagcttgttagaaatgtagaatctggtccatcccaaacctgacgaagcagaagctgcattttgccaagatcccagggaatttgtgtgcccgttatggtttgcgaagtgcttcccaagagaacatacggcaagccagagggatctttgcagatcttgctcctttcattctctggcctcatcttgtcgctctcctccatccgtgcccacatccccactgtactggaccgcttgcagctccttgaatgcagcatagtcttgttttcttttttgcagtgattctacatctttcccatcttctccacctggatgcctccatccatcctttcagacttcccttctctagcaaacctttcttgctaattcccatgtctaacacaacacttccccatactgcatggccattatcctttctgcatcagactgtgagcaccttgaaggcagtggcagtgactcattcattgtggcatctgcagattccagtggactgccaggcatgcaatagaaaatcaaaaaagatttactgctaaataatcctcaactccagtggcagctccatgtgccatttctcttccgctctggcctcggctcttcctgtgcctacctggggcttggctttcacctaggtgtctgcatggaagggagagcgacctggaggaccatcgccaatccatcaatagcctcccggttgagatgacttcagctctgatttggaagagctatgatattgtttataggagtgaattaatatgtgtaaaggttacaaagtaaacagttaaattaaattaattgtgctggagcaggtcaaacaggcttctgagagatgaacatacacatctctattaactccacattcagtgagtgtgggtaacttgaaattggctgggtcaccatttacatcatagaaattggcaaatagtacaaattagggctccctcacccctactcgggcatagagctggtacactagcacacctctggttatacatgcatgcgtgtgccaccagaacaaaacacctaacagcaggcacgttgcctctgttgcccaccattacagctcccgcacggagcagacagactcatggcaggaattgaatgcatgtttgtcgagtggaagcatgaacaaatccacaaaatgcccaagatgaggcaaagaaggacattggctcaaatgttaaacataagttaggagctgagataatgcccagaggaaaaatgttctgtaattctaagtaaaacccatctctaaggcaggatgctgcttatgagggctccacagacagatgggggaggcctgggtcctgcccttggaaagagtctgacagctcgacttctggaaacagccatctgcacaggtcaacatcttcttagctgacagggagcagatttgcagaccacatcacatttgaaattccagaagaaacttcttggagtctgctcttgtgcaaatgagcctagaaagcccgttaactttgggtggaggcttccactgtttggctatcccaagtgggcccaaagctaaggaaaacccaccagccctttgcttcctgcttcctctatttgtttgccccaggaaatcagaggtgatgacatgatttggcttgggcacgacaggaataaacgatatttaagagacgtca

SEQ ID NO: 169082 - DNA, 1873 bp, Homo sapiens
  Payload ID: 13280
  Gene Symbol: PRNT
  Gene Name: prion protein (testis specific)
  Uniprot ID: Q86SH4
  ENST ID: ENST00000418528
  CDS Start-End: 479-763
gtccctagagacagcctggaaagattgggtgccagctgcagagaggagagcaaggcgaccaaacgcaggctgtggctgcctgcagcccatcctgcccccagcacctagagtcatctttagaaatgcaagcctgatcgtggaatccaccttcctaacacccttcagtgccctcctcttcgttacacccttactatacaaacgatagtccatggaccagcagcatcaacataaccagggagcttgttagaaatgtagaatctggtccatcccaaacctgacgaagcagaagctgcattttgccaagatcccagggaatttgtgtgcccgttatggtttgcgaagtgcttcccaagagaacatacggcaagccagagggatctttgcagatcttgctcctttcattctctggcctcatcttgtcgctctcctccatccgtgcccacatccccactgtactggaccgcttgcagctccttgaatgcagcatagtcttgttttcttttttgcagtgattctacatctttcccatcttctccacctggatgcctccatccatcctttcagacttcccttctctagcaaacctttcttgctaattcccatgtctaacacaacacttccccatactgcatggccattatcctttctgcatcagactgtgagcaccttgaaggcagtggcagtgactcattcattgtggcatctgcagattccagtggactgccaggcatgcaatagaaaatcaaaaaagatttactgctaaataatcctcaactccagtggcagctccatgtgccatttctcttccgctctggcctcggctcttcctgtgcctacctggggcttggctttcacctaggtgtctgcatggaagggagagcgacctggaggaccatcgccaatccatcaatagcctcccggttgagatgacttcagctctgatttggaagagctatgatattgtttataggagtgaattaatatgtgtaaaggttacaaagtaaacagttaaattaaattaattgtgctggagcaggtcaaacaggcttctgagagatgaacatacacatctctattaactccacattcagtgagtgtgggtaacttgaaattggctgggtcaccatttacatcatagaaattggcaaatagtacaaattagggctccctcacccctactcgggcatagagctggtacactagcacacctctggttatacatgcatgcgtgtgccaccagaacaaaacacctaacagcaggcacgttgcctctgttgcccaccattacagctcccgcacggagcagacagactcatggcaggaattgaatgcatgtttgtcgagtggaagcatgaacaaatccacaaaatgcccaagatgaggcaaagaaggacattggctcaaatgttaaacataagttaggagctgagataatgcccagaggaaaaatgttctgtaattctaagtaaaacccatctctaaggcaggatgctgcttatgagggctccacagacagatgggggaggcctgggtcctgcccttggaaagagtctgacagctcgacttctggaaacagccatctgcacaggtcaacatcttcttagctgacagggagcagatttgcagaccacatcacatttgaaattccagaagaaacttcttggagtctgctcttgtgcaaatgagcctagaaagcccgttaactttgggtggaggcttccactgtttggctatcccaagtgggcccaaagctaaggaaaacccaccagccctttgcttcctgcttcctctatttgtttgccccaggaaatcagaggtgatgacatgatttggcttgggcacgacaggaataaacgatatttaagagacgtca

SEQ ID NO: 169083 - DNA, 3980 bp, Homo sapiens
  Payload ID: 13281
  Gene Symbol: PRND
  Gene Name: prion protein 2 (dublet)
  Uniprot ID: Q9UKY0
  ENST ID: ENST00000305817
  CDS Start-End: 72-602
gggtgtgctgggggactgtgcagctcgaggctccagaggcacactccagagagagccaaggttctgacgcgatgaggaagcacctgagctggtggtggctggccactgtctgcatgctgctcttcagccacctctctgcggtccagacgaggggcatcaagcacagaatcaagtggaaccggaaggccctgcccagcactgcccagatcactgaggcccaggtggctgagaaccgcccgggagccttcatcaagcaaggccgcaagctcgacattgacttcggagccgagggcaacaggtactacgaggccaactactggcagttccccgatggcatccactacaacggctgctctgaggctaatgtgaccaaggaggcatttgtcaccggctgcatcaatgccacccaggcggcgaaccagggggagttccagaagccagacaacaagctccaccagcaggtgctctggcggctggtccaggagctctgctccctcaagcattgcgagttttggttggagaggggcgcaggacttcgggtcaccatgcaccagccagtgctcctctgccttctggctttgatctggctcacggtgaaataagcttgccaggaggctggcagtacagagtgcagcagcgagcaaatcctggcaagtgacccagctcttctcccccaaacccacgcgtgttctgaaggtgcccaggagcggcgatgcactcgcactgcaaatgccgctctcacgtatgcgccctggtatgtgcctgcgttctgatagatgggggactgtggcttctccgtcactccattctcagcccctagcagagcgtctggcacactagattagtagtaaatgcttgatgagaagaacacatcaggcactgcgccacctgcttcacagtacttcccaacaactcttagaggtaggtgtattcccgttttacagataaggaaactgaggcccagagagctgaagtactgcacccagcatcaccagctagaaagtggcagagccaggattcaaccctggcttgtctaaccccaggttttctgctctgtccaattccagagctgtctggtgatcactttatgtctcacagggacccacatccaaacatgtatctctaatgaaattgtgaaagctccatgtttagaaataaatgaaaacacctgagctggtggctgtgtactttgactggtacatggaggctattttaatccttctaactaaactaaaatagattaaaggaattaaactaaaatacaagtaaagctagacaaaggcccagaaatcatactgtaaggaaatgttattggaagctgattcccagagcagaccacatatacagcaggatgtgcctgtggcatgaagattttctttctcttttttttttttttttagatggagttttactcttgttgcccaggctggagtgcaacggcatgattttggctcactgcagcctctgcctcccaggctcaagcacttttcctgtctcagccttccgagtagctgggattacaggtgtgtgccatcatgcctgactaattttgtatttttagtagagacagggtttcaccatgttggccaggctggtcttgaactcctgacctcaggtgatccacccacctgggcctcccatagtgctgggattcaattttttttttttttttttcaaaagaagggtaagtgcttgctgttcccatccctgaaacattgcatgtatttaagaaaaacaaaatgttagtggcatatttgcttctaatgttcccctaaccctacatgcatgttttatgtgcactcatatgagtatctttaaatataatccctttacatctgtgttctatgcaaagtctctcatttctttcaagacagcctaatgaaggccatcatctctgtaaaccacttgtcactacaaaaatacaattactcaccaaaaagctttaaaaaataaagctgtgtctttagggagacccaataaagaatgcaatccatgccataagcaggagttgatacaccaccttattagctaaaaatatatataacacaatatgagtaatgtttaagatctgttttaaatttaaaacaatgaattgaatgctctaagaggctcctacaggcgctccaggccactctcagagactcccaggagttgttgaactatatttggagaaaacagccactgaatattatcatttctcctttaaagagagtttgtaaggggggaacatgcattttatcagacaatttatccaaagcattgcagaacatgagtgctgatgagggcacctcttgtgctgagtcccctcagctatcagtgttcttctcaaggacacatttggaaggttttaacattgaaagtgagcggaggacttgggggcagagcagcacaaagaaacagccttacactgggcacatggaggagacgtccaccctgcagccaggactggggttcacgtcactgccagagctacactcgccttctgcttccacggtcctgttaattctagatcagagagcaagaaaaaagtacagaacatatcctctacggttatttcctgctttctaattaaaaaaataataaccatggcaagagagaaagaaagagaaagtactcagaggctgacactgacatttcacttcctcgctctcctaagtttaattacaacagcacgtgcagccacgtcagccaaatgacttcatttctgatgtgaaaacgcttaggccatgatgtcgttcattttctgtaattgctgccttttctcattctgttaatagtcccggcaaccagatttcagtggggcatgacgtgaatgtgtatatggtgattcaaatgcaaaatttgtttatggggcttttaatcgaacgcgtgtgtgcctgaacattcttgctcaagttgatgaatcatggggtggaataaaggctgagtttagtttttcactttagcaaaggggcaatggggtgcctactatgtgcgagacattgggaggggcttctgaattattctggatatcgtcattttgcagtgtgcataattttgccaaccgttgctttcgtagcccctgctaagtgttgactttttaaaatataagtttattgtaaaagtgacatgaaaattacaacagatattccagaccaaaataatacaacaatcccagcatctgattgagtcagtgtttgctgtttcccctgcactttcctagttcttaagcatttgcgtatgtaaacattcatatttgcaataaaaaagtgagcttttatattctaaatttttacttaacttaattcaatgctttctactcatttttctatacttttttttttgaggcagagtctcattctgttgcccaggctggagtgcagtggcgtgatcttggctcactacaacctccaccttccaggcttaagcgattctcatgcctcatcctcccaagtaggtgggattacaggtgcccaccaccaagccctgcaaatttttttgtatttttagtagagacagtgttttgccatgttggccaggctggtctcgaactcctgacatcaggtgatccacctgcctcggcctcccaaagtgctgggattacaggtgtgagccaccacgccctgcctactctttgttttctttcctccccacccattttcccccgtcctgtcccctccttccagcctgagatgtaggctccaccttaactgtgctcagatacacaagtgagggctttttaacttgattatgccttttaaaaatactatgtatgtaaaatatttattcatctgcaatttggcttccctaacttaacattgcatcatgaaactctttggaacaacagctatctagatagctgactcattcttttggattgctacgtaatctcacttaatacagatgtatcatgattgattgaatcattgccttgttgatgggccttcagattatttccagttttttgccactgcaaacaataaacatccttgtacatacta

SEQ ID NO: 169084 - DNA, 9129 bp, Homo sapiens
  Payload ID: 13282
  Gene Symbol: PAWR
  Gene Name: PRKC, apoptosis, WT1, regulator
  Uniprot ID: Q96IZ0
  ENST ID: ENST00000328827
  CDS Start-End: 374-1396
ttttccgctcgtgcttcggcgccgctcggctcccttcccgcccctggctccctccctccctccctccctccttcttctccctccctcctgtcctgggattgcctggagctccgcaccgcgagtttgccgcggcactttccgcgcggcggaagagcgcgcgccagcttcggcacacctgggagccggatcccagccctacgcctcgtcccctacaagctcctccaagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactattcagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaatattgaaaaattgaatcactttaactcctgaaaaacatacaattgtaatttcaatgtaaaatttcttatgtaggtactacctttttttatcgttccaaggtttgctagtgaacacaggatattttaaaagttttttattcttcgggcctggaaagtgtacaaagtcagtgtaggagaaaaaaatccatatttttatattagcatgcacactaaaaaccaaaatattattcatacttaaaacattcatacaaaacaatatgtaagcagaaatagtactaaaatactttgcctaatttctaagttgaagaataacactgggacacagttttttcatatgagagaatattccgctatttcaaatttaagggattttcttcctaacattgaaattttaaaaacagagttacttctaaataattatacagattttttcttctattaaatattattatttagaattgtttttgtattacatattcatgttaagaaccccgtcttcccttaaaatacattaaaattatgacatttttgctttgtgattgaatttcaaatagcagtatggtatccttttatctagttaatatatgaaagtggcttgaatatagtcaaatccattttaggtactctactgactttttccttcacttgccaagcccttttattgttcactgttagaaaaatagagaaggtgagacagctgggggaaaatgtggagtaaatgataatcaaatgttgaattctaaaagtctctacatttacctaggttggctttctcccccagttcagaagtttccagcttggccaatcatcagaatcacttgaggaacttagaaagaactccctggctgtagctcctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaattattaatacttttaaagactgagctgtttaagaattttttggggaacatttctagcagtgatttttttggcctttaatgatagcgtaaagacaggagccttacaacttaggcaaagcatttcacatgcagtccttcttccatctcaaaatatgtacttattttacatacagaattttacactaaccattgaaaaataaagtaggatctgctacagtttcacctgaaaatttataaaaagtgttgagattggtagaaggtagtttttaagtacatgtgcactaccctaaaagacttgtctattgtcaataaagtgttagtatttgtgaaattattattcctgttcagaaatactatttcttaaatctcctgggaatttgtggcataataaagcacattcaaagttctaatgtatttatgagctcattttcaaaatagtaagtttgtcatctttaaaatgaacatgacttgcctccttgatttctgaaatgaattaattgaagattgctatagtaatctttatttcatctttctagagttgttgacaattttattatacaacagttaccattagagaaggagggaagggcttttgggtgtgtatttataggtactaagggatttactaaatatagtagattagcactgtcacacttgttcaagtagtttcaaacatagaaaattaagtatcaggtatgtggagcaatgtagtttttttttttcttcagtttaaaaaatttttaattgtggtagaagcaatgtattcttaaggtgaaaaacctacctcggttacatgtggtttgtgttttttggattaatctggattttataattagaaataaaaatgtaagattttgaatccacttaatttcttgaaaatagtacaagtcagtgtaatagagaagcattcatatattcaacactgtaagacaaaacagcagagaccttggatttgataattgatctgatatcctggacagtattcatatgtacagtgataggtatctttctttggagttttttttttgtgcatatgtgtatagttttatgggttctgagttggtgaccagtaagttgcatgtagtgctggcacttacttaataactattcatgatattgttaataacttgttataggattgtattcccaattacagtctctaagattgtaattgatattatctgagaggtagtgtgacaactttcttttgttgttacattaagccgaaaacataatactaatagacaactaacagtttgcttatcaggcacatcaactaaggcacctccccccatgctaagtttctcctggatatatggaagttgattgtttcccagtttaaaaacttgaactaatatctcctaagaaaatctgagtccatattgtttttattttacttagctagaatctcatagcatgttaaagtcatatccttatccccactaaaaataactatgtctatgtgagaggaatatagtatgtgggagctgtattaaatactattacaggtgttacagaatctttaaataaatggacatggaccaactttccatctagtagtgtacgatctatatagtgcatgtcagtagcacaaaatgcagtcttagcattagcctgtctaatctgaatagtttactcaaaagtacttctttgtgttaagtattcagccactgtttttagatctagttaataggttctatttaatttgctacaacatttactgaatggtggagtgaaaaaactgatgcatactgggaaatatctaccattttttaaagataatgttaattaggaaaagaacacttttaaggaatttatagcagtgatgaaatgaattcagttatatcagatacaccaaactgttgatggtatttaaatgtgacttcaagttagtatttctgtatatattattgattactggtttgtttttagatatgtaagtctgttctaatctacagttcacatatcgacagttactctggtaataatagaatgttagtgatgatcacttggtggatgttgattaagtgcctgtgttttgtttcctcctctggataccaaataggtgtatgctacttttttggtgaacttatttcttggaagatttggctatgctattcagggtttttattcttatgtttttcttctaaatttaagtagcatcctgctgctaccatattaaagctaaaatttaacttttgctgaagaatcagctaattcaggtaatccaaatatttgtggaaaaacatctggataatttattgaacacattagtattgtgttagacagctttgatcattcccatttcataggtttttattgtggaatagtcaacttaatatagattcactttcaatttgcatgtataaagtaatactcaataaaatttttttcatttatttttcaacagtggttattttttttcttcctgtactatcagtaaaatcctgactatgagttttacttttgaagctaaaggataatgctggtaatctaattatgtacctcttacagaaaccatatgcagcactttaaaaatctttatttggtatattattttaggtggacaatgatttaagactcaaagccatcatattaaggtctaaatacattagtggtggggtttctcgaataaatgaggaagtgcacaaaagttcagcctgactgaaaattttaattgtgttttaaaactacatgaataatttcttgattcaaaatcagaactcttataaactaaatctgatggtgtccaaagaatttcaggtccttcaaagtttgtaaaagataagtaggggcctaggaatataaaaatttagacttttttagtaaatggtttacataaccttttgtcttaatttgtcattcttcatacacaggcacaagctaatcagtcttctctacttctagaactctaaatcttctcagtaatgtcatacaagtctaacaagaggaaaagcatccttaagtcagtctatttagataaactcttcaagtccctatataaggacgtattccactagcaagccagtaaatttttccaaggtcacataatcttacatgaaatggaacctttcatcttagacttcatcaaactcaattttttcccttctagattcactttgtgtttatgcatgcatgcacgcgtgcacacaattctatcagcagctgtaaactacccacatattttcttaatctcattttttcagtttttcttcatctttaaaagaggttacatttcattcctggtcaactcttaaaaagaattatgtaatgttgggccttcatattaaagagagagactggttataagatcctttacagtccattcattttattctgatgtctaaccagatagacactagcaagcaaaacttccctcttaatcctggaccaaatgcataattttactgtcactttcaaaaatctgttatgactgaatcaaaatccttttaaagaaaggaaaaagctccttttgtgtcaaatagttgaacaacatgaaaacagtatgagccggttaaagatagattgaatttttactttacacatatgaaaaacagtaagttttgactgctgtgtatgttattcatgttaatatgtgctcagttattcactattgttaatccacatataatcagttgctatccctggttagacacactatggaacttgaaatgcacaatatttacattgttagaggcttctatccaaatatctgcattcctttaaaatgtgaactatttgctgtgattaaccaaaggtagattatgtcatcagtggacattttagctttatggaaacaaattattaagaaatgaatagaaaggtgtctttttctttgtgtagtgcaaaagcctaaagctatcagtcaaaggcctaagaaatccacatttgaaaaacgtaaatcatgattggtaagaatacattcatctgatagtattgagaaaagttgaaaaactgttagccttccataacacattaaacattttatgtatggatggctgaaagtattgagaaaagctgaaaaactgttagccttccataacacattaaacgttttgtgtatggatggcttaggacaataaacaacatcattaaagtaaaattatgtcagtctgttcatattaacttatttaaatcaatgaaaattttgatgagatgactaaatggatgctttggaaatgcaggattataggaggcctaaaagtgcatcttgtttcttgtaacccttttaaaaccaatatgcctggctaggtgcagtggctcatgcctgtaataccaacggggtaacacagggttatgccgtctatacaaaaaaataaatgagctgggcaagatggcatgcacctgtagtcccagctgcttggtaggctgagggggaaggattgcttgagcctgggaggtcgagactgcagtgagccaagatcacaccactgcactccagcctgggtgacagagcaagactctacctcaaaaataaaaataatcaatatagtttcaatgaagcaaagcatctcaggtaacaatttgagcataactttaaccataacttatgatagcataataacattcattagtaattcagtagccgtatgtgccaggctgtgttaggtgctttatatattgtttaatttttaaaaacttgtggagtgtacagattggtaaggtgacattgtatcacaaagctagtctttgagtccaaagttttgtggttttatgttatgatatacttttatcatggaattgtcttattaaatgttttgccagtggttcttaaagtgtgtttctgacaccagtagcattgacttcacttagaaacctgttagaaatacaaattatttggccccacccaacacttgagtcacaaactttgcagatggggctcaatctgttttaacaagcgcttcatgtaattttgatgcaggcctaagtttttgagccactgcagtatgcatttctatttttaagcaaagatcttggtctttctttttggacattgtagaaataacatgaacttgttttttgtttgtttttgttttgttttgttttaagctcctgatctttgttggttatgttgcaaaagattgtatcaggagaagcctcagcatggacattggcatcctgacataacccccattaatttagtattctttctgaaactcaaatggattctcaagtccaagagactatggaataaaatcattgtttgtctgtgttaagttttatctctgttattgcctgaagacttttggtaacaataatgcgctttcatcaaacttttaagacttgattggaaaaaataaatgtatgtttcatcagttatacaa

SEQ ID NO: 169085 - DNA, 494 bp, Homo sapiens
  Payload ID: 13282
  Gene Symbol: PAWR
  Gene Name: PRKC, apoptosis, WT1, regulator
  ENST ID: ENST00000548426
  CDS Start-End: 268-494
gcctcctctgcgaaccggctaggagctccgcgcctcgccttgggagtggggttgtagctgacggggacctcggaccggcggtggctagagcgcggagcaggcgatacgacgagccgacagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcgg

SEQ ID NO: 169086 - DNA, 482 bp, Homo sapiens
  Payload ID: 13282
  Gene Symbol: PAWR
  Gene Name: PRKC, apoptosis, WT1, regulator
  ENST ID: ENST00000550603
  CDS Start-End: 1-219
aagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccagctcctgatctttgttggttatgttgcaaaagattgtatcaggagaagcctcagcatggacattggcatcctgacataacccccattaatttagtattctttctgaaactcaaatggattctcaagtccaagagactatggaataaaatcattgtttgtctgtgttaagttttatctctgttattgcctgaagacttttggtaacaataatgcgctttcatcaaacttttaagacttgattggaaaaaataaatgtatgtttcatcagtta

SEQ ID NO: 169087 - DNA, 1573 bp, Homo sapiens
  Payload ID: 13282
  Gene Symbol: PAWR
  Gene Name: PRKC, apoptosis, WT1, regulator
  ENST ID: ENST00000551712
  CDS Start-End: 1-583
gggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactattcagaatgaagctgtaaacttactagatccaggcagttcctatctgctacaggagccacctagaacagtttcaggcagatataaaaggaagagagataaaccctacacagagcaaggagctgttacgaggagtgggagtgttggagggtgaagagaatggggcagtgaaagatactaaaaggatggaagccagttaagtagttgttggttatttgggaatttcagaatatatcctgtacttctgaatatttgatacttattctaaaagtaggatttacccttgagtcttgtatttcttctcattgctaagctttataatgtctattttagtggaaaattcctctagctataatctcttaatgctgccaatctcattctcatgatagttttagaataatagtgtaattttccccaacacaacaccccctggtgtttctacataagatgcgaaaattcccagagggggaaaacttccagtaaggggtggcatttatctttgatgatactgtttcttttcccttttctgagcattatagttcatgtctttgtagctaagagtggagggaggattctttttggatcgtattagagatttatgttaacattcctaagtaaaatgttaaaaactttttggagttaatgaacaatcttttattctgagtattttgcactgtgcatatctggctttcaaaataggttaaatggctaaatttggcaataagatcaagtaacacaattcttcacaattatgacagtattccctaaaacataatacatattgggaatgaagcactgattttgtttttcactattccttgcatttgcataatgaaggccgggtgtggtggctcatgcctgtaatcccagcactttgggaaggccgaggtgggcggatcacctgaggtcaggagtttgagaccagcctggtcaacatggggaaaccccatctctactaaaaatacaaaaattagccgggcgtggtggcgggcgcctgtaatcccagctacttgggaggcggaggcaggagaatcacttgactgcaggctgaggttgcagtgagccaaaatagtggcattgcactccagcctgggcaacaggagcgaaactctgtctccaaaaaaaaaaaaaaaaaaaaaaaaaa

SEQ ID NO: 169088 - DNA, 364 bp, Homo sapiens
  Payload ID: 13282
  Gene Symbol: PAWR
  Gene Name: PRKC, apoptosis, WT1, regulator
  ENST ID: ENST00000552637
  CDS Start-End: 174-364
ggcgatcgtcggggtccgtactgtagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgc

SEQ ID NO: 169089 - DNA, 2159 bp, Homo sapiens
  Payload ID: 13283
  Gene Symbol: PRKRIP1
  Gene Name: PRKR interacting protein 1 (IL11 inducible)
  Uniprot ID: Q9H875
  ENST ID: ENST00000397912
  CDS Start-End: 50-604
atacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccatgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 169090 - DNA, 3430 bp, Homo sapiens
  Payload ID: 13283
  Gene Symbol: PRKRIP1
  Gene Name: PRKR interacting protein 1 (IL11 inducible)
  Uniprot ID: Q9H875
  ENST ID: ENST00000496391
  CDS Start-End: 1311-1865
ctgcgcctcttcaggtcatcgcttgctctcgttcccaggctttggcctctagtggacgagaatcaccgagtctgcggggctggacgctgactgcccgggccagcacctaggcgggcgggagctgtgcggcccagggttcacgcgggccgggtagaggctcgagccgggacccccgagcgtgaaccccggagccggcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacccccgcctggatttgccccgtaggcccggcccgggcccctcgggagcagaacagctttggtgaggtggacaggaggtgacctcgcgagcagacgcgcgcgccagcgacagcagcccgccccggcctctcgggagccgtggggcagaggctgcggagccccaggagggtgatttctgcctttgcaggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggagattgtcagaaatggaggagggggcaccagatccaaggaagtgcccggacaaagccgggaggcgaggagagccgacggggaggaggtgccgagagcatcagcggggctgctcggtggcacgaagacgcccgcggggactggagaggtcggctagggccaggctactcaggcacggagggccacctccccttcagggacgtgagcatctagctgcactgatttgttgttcaggaacaggaaatgaaaccccgcagctttgaacacaataacccacgccagcctcaggctcatgaatattcagcaggctgcttgcgccttgcaaccccgcctccgttcccctctgcggagactgcgtatgcgtcgccggcgcgcggctgtgtcgtcatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccatgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgtacattttgaaa

SEQ ID NO: 169091 - DNA, 884 bp, Homo sapiens
  Payload ID: 13283
  Gene Symbol: PRKRIP1
  Gene Name: PRKR interacting protein 1 (IL11 inducible)
  ENST ID: ENST00000462601
  CDS Start-End: 71-454
ttatcaccaagccaaacatcatcatggagtggaggtgaaggaagtggagcagggagaggagccgtggataatggaaggtgaatttccatgtcaacatagtccaggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgt

SEQ ID NO: 169092 - DNA, 1680 bp, Homo sapiens
  Payload ID: 13284
  Gene Symbol: PANO1
  Gene Name: proapoptotic nucleolar protein 1
  Uniprot ID: I0J062
  ENST ID: ENST00000620120
  CDS Start-End: 116-763
agacagcaggagagcagagaccaccccacaggaagataccgctgcttccgaatctgcaggggtaaaatcctccacccaagaagccgccaggctcctcctacccccaagaaaggcaatgggggtgaggctccgagtctggccggcggctccccattcaatctcccgctgtccccgtcctcttggggcggtgctttctatcctgctggctggagggtcccggaaggggactccaactgcgcgatgcctcggccagaggacaaaggagaagcgggttgggggccgctctctgcgctcggaggccggctcaggcccctgccctactgctggggctcagccgaccgctccgtcctccgcctggccaccgcgactccggccacgcacgtgtccacagatgtccggtgaactcccacgtgtgcgtcccacacgggtcggcctttcttccttgggctcgggccccggacacccaccctcggggacacgtatgtgcggggagcgcgcccggaaccgtcggggccgagcacggcgtctcacgccagagcagccgcggatcggagcatccgctggtccaggaccccccctcccgcccgccaggccacgttgttcgggcagctgtcacctccctcggccgccgcagcacctctcgcccccgcagcccggccgcgttcggatgggcgcagcagaagggagccgccgggcagacactcaccacgctcgccgccgccgccgcgctcgcctgcccgccccgcgctcggccagcacctaggcggggaggcgcgtccgctcggcgccgcgcgcgctccgccctcggcctcctccgggcttcggctccccctcctggccgtcgaggctactgcgcccagccaggccacagccacgcgcccacccgccccctggccgtgggttcccccgggcagggtggcagttctgcgcgcagaggccgggccgcgcgtccccaaggtcctttcttggtttccgggcctcaggcccctgcaggcacaaggacccgcggggcgcgggcaggtggcagagcgccggtggatgagggtgccctgggggaggcgtggcctccagggcagacacaggtgatccgtggaactgctgggccagcgcaatggagaagtggaggcacaaccccacccgccgaacagcgactttgtatccaaagcaccccacttggggctgggcgcagtggctcacacctgcaatcccagcacttttggaggccgaggcaggcggatcacttaaggtcaggagttcgagaccagcctggccaacatggtgaaaccccgtctactaaaaatacaaaaattagccagcgtggtggcaagtgccctagtcccagctacttgagagggtgacgcagaatcgcttgaacctgggaggcagaggttgcagtgagctgagatcatgccactgcactccagcctgggtgacagaaactccatttaaaaaaaaaaaaaaagtagcccatgtgggttactttgtagcacagctcctccctcccaggaagatgaggacccacaggaggccccaggcacagtgggagaggacaggaccaggatgtggggcacctgtgcacacaggcctccctccccgcaggggccaggcctctaccccaccaccctccgccctccaacggcttctccatccaacaaataaatcaagctctgaggtgaaaga

SEQ ID NO: 169093 - DNA, 1702 bp, Homo sapiens
  Payload ID: 13285
  Gene Symbol: PCOLCE
  Gene Name: procollagen C-endopeptidase enhancer
  Uniprot ID: Q15113
  ENST ID: ENST00000223061
  CDS Start-End: 281-1630
gatgacgttacttgaggcctgggagacggcctctgcccctcactgctcctccccctcctaaggtcaacatttatgtgtcctagacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaa

SEQ ID NO: 169094 - DNA, 2021 bp, Homo sapiens
  Payload ID: 13286
  Gene Symbol: PCOLCE2
  Gene Name: procollagen C-endopeptidase enhancer 2
  Uniprot ID: Q9UKZ9
  ENST ID: ENST00000295992
  CDS Start-End: 308-1555
gaacaaacgggatattcagcagtggcctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattaca

SEQ ID NO: 169095 - DNA, 773 bp, Homo sapiens
  Payload ID: 13286
  Gene Symbol: PCOLCE2
  Gene Name: procollagen C-endopeptidase enhancer 2
  ENST ID: ENST00000480473
  CDS Start-End: 1-304
tggcactttccggcctggagcccttgtgtccagtggcaacaagatgatggtgcagatgatttctgatgccaacacagctggcaatggcttcatggccatgttctccgctgctgaaccaaacgaaagaggaaaaaaaaagaaaagaggccctgagtccacttctcccctctctcgtgttgctatgctatgtcaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaa

SEQ ID NO: 169096 - DNA, 728 bp, Homo sapiens
  Payload ID: 13286
  Gene Symbol: PCOLCE2
  Gene Name: procollagen C-endopeptidase enhancer 2
  ENST ID: ENST00000470310
  CDS Start-End: 1-423
acagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggagaatctcctattggtgaattacaagcagcatgctggcgggtatcaagcttctgcatgaccagcggaaagacttcttcaggccgtcaccagatgtgggcccttgactttggacttcccagcctccagaactgtaagaaataaatatctgttctttatgaa

SEQ ID NO: 169097 - DNA, 1088 bp, Homo sapiens
  Payload ID: 13286
  Gene Symbol: PCOLCE2
  Gene Name: procollagen C-endopeptidase enhancer 2
  ENST ID: ENST00000485766
  CDS Start-End: 4-915
gccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgctattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaa

SEQ ID NO: 169098 - DNA, 2940 bp, Homo sapiens
  Payload ID: 13287
  Gene Symbol: PLOD1
  Gene Name: procollagen-lysine, 2-oxoglutarate 5-dioxygenase 1
  Uniprot ID: Q02809
  ENST ID: ENST00000196061
  CDS Start-End: 28-2211
cggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 169099 - DNA, 886 bp, Homo sapiens
  Payload ID: 13287
  Gene Symbol: PLOD1
  Gene Name: procollagen-lysine, 2-oxoglutarate 5-dioxygenase 1
  ENST ID: ENST00000429000
  CDS Start-End: 38-886
gccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggtgtctccctggggccagggccaccttcctggggcctgctatgaactcactgcctctgtcctcacatctgagctcagcgtgatgccttcttttcctgctgtggtgctgcagttgaactacctgggcaactacatcccgcgcttctggaccttcgaaacaggctgcaccgtgtgtgacgaaggcttgcgcagcctcaagggcattggg

SEQ ID NO: 169100 - DNA, 762 bp, Homo sapiens
  Payload ID: 13287
  Gene Symbol: PLOD1
  Gene Name: procollagen-lysine, 2-oxoglutarate 5-dioxygenase 1
  ENST ID: ENST00000449038
  CDS Start-End: 87-762
gtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggccccctgttgccaagagggcctcagagctggtggctctggttctcttcacctggggagagacttcaccgtcctggcaggagctcgggggagcccttccccaagtgtgagcagcatccctcgtttctggatcccaggttcagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcg

SEQ ID NO: 169101 - DNA, 3732 bp, Homo sapiens
  Payload ID: 13288
  Gene Symbol: PLOD2
  Gene Name: procollagen-lysine, 2-oxoglutarate 5-dioxygenase 2
  Uniprot ID: O00469
  ENST ID: ENST00000282903
  CDS Start-End: 179-2455
ccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 169102 - DNA, 3665 bp, Homo sapiens
  Payload ID: 13288
  Gene Symbol: PLOD2
  Gene Name: procollagen-lysine, 2-oxoglutarate 5-dioxygenase 2
  Uniprot ID: O00469
  ENST ID: ENST00000360060
  CDS Start-End: 179-2392
ccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataatttta

SEQ ID NO: 169103 - DNA, 3043 bp, Homo sapiens
  Payload ID: 13288
  Gene Symbol: PLOD2
  Gene Name: procollagen-lysine, 2-oxoglutarate 5-dioxygenase 2
  Uniprot ID: O00469
  ENST ID: ENST00000461497
  CDS Start-End: 510-1766
aagtgctgactgggaccgacagtgagggaggggagcccagagggaagttgataacccaaatgtcatctggtatctccagttgttcattccttgatattgctgatgataatgttacaaactgtaccagggaaagcaaacatagtcactgcccctggtaagaaggcaggggaataactatcttagaaaatttgatgaaaatcaagtttgtaaaatattaatacctgaaaagtcatatacttacatctccaacattcatttaaaactgagttgtgggatatgtaagttgcatttgtgtgcatgtgtatgtatgtatgtatgtatgcagaaacattttgatttgtggatgttttatgccttaaaatatttactggcttgaaaatatattttaactggcttaaaattttagaggtgagctccctgtgaatatccgtgttaaattgaccattttgaaatttaagacaatatatatatcgtttcagatattgttccactattttgatcagaaaagtatgctagagaaccatattttacataaaagaatatatatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 169104 - DNA, 550 bp, Homo sapiens
  Payload ID: 13288
  Gene Symbol: PLOD2
  Gene Name: procollagen-lysine, 2-oxoglutarate 5-dioxygenase 2
  ENST ID: ENST00000480704
  CDS Start-End: 3-299
atatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaagaaagaaggatctgtcagccaagtcttttctacaaataagaggagaacaaggagatacctaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgct

SEQ ID NO: 169105 - DNA, 723 bp, Homo sapiens
  Payload ID: 13288
  Gene Symbol: PLOD2
  Gene Name: procollagen-lysine, 2-oxoglutarate 5-dioxygenase 2
  ENST ID: ENST00000469350
  CDS Start-End: 36-723
aaggaatagatgaagagagaacatgaagggaaaaaatgacaagatttggagtccggctctataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggaccca

SEQ ID NO: 169106 - DNA, 2908 bp, Homo sapiens
  Payload ID: 13288
  Gene Symbol: PLOD2
  Gene Name: procollagen-lysine, 2-oxoglutarate 5-dioxygenase 2
  ENST ID: ENST00000494950
  CDS Start-End: 261-2372
aatatggggggatgcacggtgaagcctcagctgctgctcctggcgctcgtcctccacccctggaatccctgtctgggtgcggactcggagaagccctcgagcatccccacaggtgagcaccccgcggtccgccgctgtcccgcgaggctcggccggcgggggggcagttcattcatccaccagcccttccgcggggctggccagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaaga

SEQ ID NO: 169107 - DNA, 2920 bp, Homo sapiens
  Payload ID: 13289
  Gene Symbol: PLOD3
  Gene Name: procollagen-lysine, 2-oxoglutarate 5-dioxygenase 3
  Uniprot ID: O60568
  ENST ID: ENST00000223127
  CDS Start-End: 400-2616
actctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 169108 - DNA, 536 bp, Homo sapiens
  Payload ID: 13289
  Gene Symbol: PLOD3
  Gene Name: procollagen-lysine, 2-oxoglutarate 5-dioxygenase 3
  ENST ID: ENST00000440925
  CDS Start-End: 1-200
acttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgtgagtcccgccagcctgcagccccccgcctcctccgacccggggcccaggggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactaca

SEQ ID NO: 169109 - DNA, 565 bp, Homo sapiens
  Payload ID: 13289
  Gene Symbol: PLOD3
  Gene Name: procollagen-lysine, 2-oxoglutarate 5-dioxygenase 3
  ENST ID: ENST00000424135
  CDS Start-End: 1-378
accctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaa

SEQ ID NO: 169110 - DNA, 539 bp, Homo sapiens
  Payload ID: 13289
  Gene Symbol: PLOD3
  Gene Name: procollagen-lysine, 2-oxoglutarate 5-dioxygenase 3
  ENST ID: ENST00000414785
  CDS Start-End: 26-539
gtgtaaatcttgtgggagccacgaaatgggtcattttaaagatgtggtcacggtgttcttacaagaaatcttattttcctttggtccttgtgaagatgctgtgatcacaaaggcagcccctggagcttctccgggcagaagaggagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtg

SEQ ID NO: 169111 - DNA, 1098 bp, Homo sapiens
  Payload ID: 13289
  Gene Symbol: PLOD3
  Gene Name: procollagen-lysine, 2-oxoglutarate 5-dioxygenase 3
  ENST ID: ENST00000454310
  CDS Start-End: 1-794
ccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 169112 - DNA, 809 bp, Homo sapiens
  Payload ID: 13289
  Gene Symbol: PLOD3
  Gene Name: procollagen-lysine, 2-oxoglutarate 5-dioxygenase 3
  ENST ID: ENST00000421736
  CDS Start-End: 1-809
gattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcaggaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagg

SEQ ID NO: 169113 - DNA, 563 bp, Homo sapiens
  Payload ID: 13289
  Gene Symbol: PLOD3
  Gene Name: procollagen-lysine, 2-oxoglutarate 5-dioxygenase 3
  ENST ID: ENST00000456079
  CDS Start-End: 337-563
atgcttgcagttccagccactccggaggctgaggtgggaggatggtttgatcccaggaaatcgaggctgcagtgagctatgactatgccactgcactccagcctaggcgaaagagcgagaccaaaaaagaggaatgactagatgctgtgatcacaaaggcagcccctggagcttctccgggcagaagaggagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcg

SEQ ID NO: 169114 - DNA, 2555 bp, Homo sapiens
  Payload ID: 13290
  Gene Symbol: PDYN
  Gene Name: prodynorphin
  Uniprot ID: P01213
  ENST ID: ENST00000217305
  CDS Start-End: 227-991
atttgaaggggctttggtggtgttcacagctgcctctttggcacctcctcccaagccggagtcaaggaggcccctgagccttggaccagccactgccacctccgacctgctcggccagaagctgcccagggacaaagcagagtgcaggtcatttatcttcaggctttgagatctgcgtggggggagctgttgcagcagcccaagccgcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctga

SEQ ID NO: 169115 - DNA, 2725 bp, Homo sapiens
  Payload ID: 13290
  Gene Symbol: PDYN
  Gene Name: prodynorphin
  Uniprot ID: P01213
  ENST ID: ENST00000539905
  CDS Start-End: 395-1159
agaatccgccccctccccaacacggctgccttcctcctccacatccctgtcacgaagagaagcctattgtgtcaggcccagggagttcgagttgaagggcctgggggtctgtgctctgactgctctcagccacttccccattggctcccagcagcctgtgctcagcaagggctgagcgacaggggaggctctcgtccataaaaggggggaagaggcaccagaactgccatttgaaggggctttggtggtgttcacagctgcctctttggcacctcctcccaagccggagtcaaggaggcccctgagccttggaccagccactgccacctccgacctgctcggccagaagctgcccagggacaaagcagagtgcagcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctgatg

SEQ ID NO: 169116 - DNA, 2472 bp, Homo sapiens
  Payload ID: 13290
  Gene Symbol: PDYN
  Gene Name: prodynorphin
  Uniprot ID: P01213
  ENST ID: ENST00000540134
  CDS Start-End: 142-906
agaccagtgagagactgctctttggactctccctttctgcacagtcctggcttaaacaggtggtcatttatcttcaggctttgagatctgcgtggggggagctgttgcagcagcccaagccgcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctgatg

SEQ ID NO: 169117 - DNA, 1199 bp, Homo sapiens
  Payload ID: 13291
  Gene Symbol: PENK
  Gene Name: proenkephalin
  Uniprot ID: P01210
  ENST ID: ENST00000314922
  CDS Start-End: 78-881
cggcgagggtcctgccgagggaccccgttctgcgcccaggcaggctcgaagcacgcgtccctctctcctcgcagtccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatcttttcccactagtggccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgttttcatgctaaaatagtttttgttatcttgtctcttatttttgacaaacatcaataaatgcttacttgtatatagagataataaacctattaccccaagtgcataa

SEQ ID NO: 169118 - DNA, 1029 bp, Homo sapiens
  Payload ID: 13291
  Gene Symbol: PENK
  Gene Name: proenkephalin
  Uniprot ID: P01210
  ENST ID: ENST00000451791
  CDS Start-End: 226-1029
ctgcgtcagctgcagcccgccggcgattggggcgcgcgcgcctccttcggtttggggctaattataaagtggctccagcagccgttaagccccgggacggcgaggcaggcgctcagagccccgcagcctggcccgtgaccccgcagagacgctgaggaccgcgacgagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaa

SEQ ID NO: 169119 - DNA, 467 bp, Homo sapiens
  Payload ID: 13291
  Gene Symbol: PENK
  Gene Name: proenkephalin
  ENST ID: ENST00000518974
  CDS Start-End: 151-467
gacggtgaggccctacgtccgccagcacacccgggcccgcttctccccgacgcccgccctcctcacacttgccttcttctcttccctctagagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaag

SEQ ID NO: 169120 - DNA, 772 bp, Homo sapiens
  Payload ID: 13291
  Gene Symbol: PENK
  Gene Name: proenkephalin
  ENST ID: ENST00000523051
  CDS Start-End: 133-372
gggacggcgaggcaggcgctcagagccccgcagcctggcccgtgaccccgcagagacgctgaggaccgcgacgagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggattgtgggggaggagaagaggaaggctgctctttccagaattttccatactgctttttatgctcttgttgttatcacttattactattatcattactttaatccaggtgatggaatggcacgtgtagtgttagcaacttgaaaaaaatagataataagcaaccatcaataaaaatagtcttatagaaaggcattttgcataataactgatttgcattggaccctacatttagggttgttattgtctcaatgacaaaaggtttacttagtgactgtctcgctagaattacaacattctgggattttggctcggatgcaaaagacatgtgagaaacgaggttgcctagccaaaattatgtagtgaaatcaatgtaacaaatatttactgagcttctaccatgagaaagacacttatgattggtactgtggtggatgcagagatgagcaggcgtgctatggctgatgtccagatagaatttcccatctaatgtgatcttgacca

SEQ ID NO: 169121 - DNA, 532 bp, Homo sapiens
  Payload ID: 13291
  Gene Symbol: PENK
  Gene Name: proenkephalin
  ENST ID: ENST00000517415
  CDS Start-End: 1-267
ttcctgacactttgcacttggctgctgttgctcggccccgggctcctggcgaccgtgcgggccgaatgcagccaggattgcgcgacgtgcagctaccgcctagtgcgcccggccgacatcaacttcctgaagcacccccgcatagatcaattcattcattcaacaaatgaatatttgatggaagaggctccagatggagggaagagccagtgcaatgcctcaaaatggagacatggtgtattaatggagaagcagcaggacttgtgaaagcctgggacgagggcttggggttttattctcaatatgatagaaaatgattcaaggctgagagcaggagagtggcaggatatactgacttatttaaatctcactgtctcccacaaagaacaagttttatctctcctcatgctcctgagagaagaatgtactgcttatctaccatcatttctgcatccatcgaaacatctgggtttacctgaaaagaaattatataaaactttcagtgttttctaataaaaatgcaatgaataca

SEQ ID NO: 169122 - DNA, 863 bp, Homo sapiens
  Payload ID: 13291
  Gene Symbol: PENK
  Gene Name: proenkephalin
  ENST ID: ENST00000518770
  CDS Start-End: 155-433
gctccagcagccgttaagccccgggacggcgaggcaggcgctcagagccccgcagcctggcccgtgaccccgcagagacgctgaggaccgcgacgagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggtgagtgttgcgcgcggcgagtgttgcgcaccttgtgagacagagtttccgcaacagtacgcggactgcctccggcccaccgcgcggcgcgtatggcggttcgcaccgggtcggagccgcagcggcgcgagcccgtggtgacctgggtgtctcagctgttcctggaacactgactgaagtcctgccctggctcttagcttcggggatccgcgactatctggggaccggtaagggtagcggtgtcgccgcacaaaccaagtttgttttaaccctgggaattcgggaaccccgagaagtcctctgttcagcacctcggatagcactgggttctctcctgggctgtcagaaggaagatggctgtcaccacaactcctaacatatcccagctaagggcccctccacacgcagtcatcttcccatctttcccacaaataatgtaattttttgttagtgacatttcggtgcctttctttagatttatgttccccagctctcttaacctcaggtccctcattccctaccctcacctgtaaataggagagagcaaagggatggaaaaggggtacgggga

SEQ ID NO: 169123 - DNA, 1291 bp, Homo sapiens
  Payload ID: 13292
  Gene Symbol: PFN1
  Gene Name: profilin 1
  Uniprot ID: P07737
  ENST ID: ENST00000225655
  CDS Start-End: 621-1043
ctcccggccccggcgcaggcgcaggcgcgggcacacgcgccgccgcccgccggtccttcccttcggcggaggtgggggaaggaggagtcatcccgtttaaccctgggctccccgaactctccttaatttgctaaatttgcagcttgctaattcctcctgctttctccttccttccttcttctggctcactccctgccccgataccaaagtctggtttatattcagtgcaaattggagcaaaccctacccttcacctctctcccgccaccccccatccttctgcattgctttccatcgaactctgcaaattttgcaatagggggagggatttttaaaattgcatttgcaaagttcggtgtctgggctggcgagtgggggagggagggaatggggagtaggccccgcccctaccgtcctttgcaaataaaaatctagcggggcggggggggggaggagcaggaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcaggacgcggccatcgtgggctacaaggactcgccctccgtctgggccgccgtccccgggaaaacgttcgtcaacatcacgccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagacgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaaagattctactaacaa

SEQ ID NO: 169124 - DNA, 539 bp, Homo sapiens
  Payload ID: 13292
  Gene Symbol: PFN1
  Gene Name: profilin 1
  ENST ID: ENST00000572383
  CDS Start-End: 43-539
cgggcgcgctcccgtgcagccggctccggccccgaccgccccatgcactcccggccccggcgcaggcgcaggcgcgggcacacgcgccgccgcccgccggtccttcccttcggcggaggaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcaggacgcggccatcgtgggctacaaggactcgccctccgtctgggccgccgtccccgggaaaacgttcgtcaacatcacgccagctgaggtgggtgtcctggttggcaaagaccggtcaagtttttacgtgaatgggctgacacttgggggccagaaatgttcggtgatccgggactcactgctgcaggatggggaatttagcatgga

SEQ ID NO: 169125 - DNA, 1173 bp, Homo sapiens
  Payload ID: 13292
  Gene Symbol: PFN1
  Gene Name: profilin 1
  ENST ID: ENST00000574872
  CDS Start-End: 626-940
gggggcttggggtgaaagggggaggggggaaaggttcccggggtacctagacccgagagctggcctgccgggtctggcccctgtccaccttcaaaagttttccaactttcccggaaagcccccaggggtctgcttcctcatctcagagcagagatacctggagctaaactctaggttacttggagacccaggcgtccgggccctaacagctcctgcagaacctttgaccaaataagggcaaagttgcttctcttgcctcgcccgcccccctcccttcccctctccgcttctgcttttcctgaaggagagttctgagcatccaaaggctcctcacttacctcactgactccctttatttcctgggtttactttccccattaacactgacatctaaatctctagaggagtatgtcatcccttcctccctggttccatattctaagtttcagaatcatgatctttttctgcactaacgtcccacagtcctcagagtttctcacagttcattgatgtgtactgagtatataatttatacttagcccccacggcggggtggttctcagaagtggaagacaggtgggtctttggagaacacggtgggaatcttggtgcactgactaacttgatgggcgcttggttcctcttccagccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagacgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaa

SEQ ID NO: 169126 - DNA, 2261 bp, Homo sapiens
  Payload ID: 13293
  Gene Symbol: PFN2
  Gene Name: profilin 2
  Uniprot ID: P35080
  ENST ID: ENST00000239940
  CDS Start-End: 254-676
gccgctggtttgtcagccccgcggctgcgggcggccgggcggccgagcgcgctctgaggttcgtccctcatcgctgaacccgcgtcctcccgccgcagctcctcggggaggggggcggtcggtgcctgcgcagagccgcctcctccccgcccccgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaa

SEQ ID NO: 169127 - DNA, 911 bp, Homo sapiens
  Payload ID: 13293
  Gene Symbol: PFN2
  Gene Name: profilin 2
  ENST ID: ENST00000423691
  CDS Start-End: 67-633
accgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttatt

SEQ ID NO: 169128 - DNA, 1780 bp, Homo sapiens
  Payload ID: 13293
  Gene Symbol: PFN2
  Gene Name: profilin 2
  Uniprot ID: P35080
  ENST ID: ENST00000452853
  CDS Start-End: 95-517
gcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaa

SEQ ID NO: 169129 - DNA, 858 bp, Homo sapiens
  Payload ID: 13293
  Gene Symbol: PFN2
  Gene Name: profilin 2
  ENST ID: ENST00000490975
  CDS Start-End: 70-447
gctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatt

SEQ ID NO: 169130 - DNA, 743 bp, Homo sapiens
  Payload ID: 13293
  Gene Symbol: PFN2
  Gene Name: profilin 2
  ENST ID: ENST00000497148
  CDS Start-End: 140-415
gtcttccacggagaatgcatccgcgtctcaagagtcggagtcccccgccgccgccgccgccatcttgaggagggtgtgagcgtgtattgagggggagagctagcgaagagttagcgcggcgaagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcc

SEQ ID NO: 169131 - DNA, 606 bp, Homo sapiens
  Payload ID: 13293
  Gene Symbol: PFN2
  Gene Name: profilin 2
  ENST ID: ENST00000461930
  CDS Start-End: 49-186
gcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagaggtgagtaaggcattcttttggttaaagttgcatgccacattacaacttattaagcagtttcttttaacattttgaataaaagttagtccataatggctattaaggtggtttttgtgaactgcccagcactatggagaagcactgctttagttttacctactctacagcatctatgacctggcctcttagatcctgattttgtttctacgatagaatattcgtatgaactcactttcagct

SEQ ID NO: 169132 - DNA, 942 bp, Homo sapiens
  Payload ID: 13293
  Gene Symbol: PFN2
  Gene Name: profilin 2
  ENST ID: ENST00000460404
  CDS Start-End: 49-186
gcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcattt

SEQ ID NO: 169133 - DNA, 637 bp, Homo sapiens
  Payload ID: 13293
  Gene Symbol: PFN2
  Gene Name: profilin 2
  ENST ID: ENST00000475518
  CDS Start-End: 133-408
agagcattacggtgaggaccagtggcggccggtaccctggtccctgcaccggagcggggtggccggccgcgggggcaccgcagcgcggggctggaacactgagggccgagcccgcagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattg

SEQ ID NO: 169134 - DNA, 560 bp, Homo sapiens
  Payload ID: 13293
  Gene Symbol: PFN2
  Gene Name: profilin 2
  ENST ID: ENST00000481275
  CDS Start-End: 64-339
cttttttcctcctagtgcggttcccctaggttctcttgaagccctgagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactc

SEQ ID NO: 169135 - DNA, 894 bp, Homo sapiens
  Payload ID: 13293
  Gene Symbol: PFN2
  Gene Name: profilin 2
  ENST ID: ENST00000468323
  CDS Start-End: 43-210
gctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccc

SEQ ID NO: 169136 - DNA, 662 bp, Homo sapiens
  Payload ID: 13293
  Gene Symbol: PFN2
  Gene Name: profilin 2
  ENST ID: ENST00000498169
  CDS Start-End: 27-194
cgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtc

SEQ ID NO: 169137 - DNA, 793 bp, Homo sapiens
  Payload ID: 13293
  Gene Symbol: PFN2
  Gene Name: profilin 2
  ENST ID: ENST00000494827
  CDS Start-End: 208-483
actcccaccgaggccctgcaacagcaccaagtctatttctaggcagcccatgaccagggctgagaacttgccccagaccatgagcctcccggctgagaaaacaagttaactcacagtttttcagcatctcagggagcctgcagcagtgatccagttccttcaaactgtctgtggattctctcggctttcctgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagc

SEQ ID NO: 169138 - DNA, 556 bp, Homo sapiens
  Payload ID: 13293
  Gene Symbol: PFN2
  Gene Name: profilin 2
  ENST ID: ENST00000498307
  CDS Start-End: 77-352
ggatcgcacgcacgcgcgcgcgcacgcccagccgtgtccgcggaaaacggagggcgctgcgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttt

SEQ ID NO: 169139 - DNA, 613 bp, Homo sapiens
  Payload ID: 13293
  Gene Symbol: PFN2
  Gene Name: profilin 2
  ENST ID: ENST00000461868
  CDS Start-End: 85-417
gcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagaggtgagtaaggcattcttttggttaaagttgcatgccacattacaacttattaagcagtttcttttaacattttgaataaaagttagtccataatggctattaaggtggtttttgtgaactgcccagcactatggagaagcactgctttagttttacctactctacagcatctatgacctggcctcttagatcctgattttgttt

SEQ ID NO: 169140 - DNA, 1620 bp, Homo sapiens
  Payload ID: 13293
  Gene Symbol: PFN2
  Gene Name: profilin 2
  ENST ID: ENST00000481767
  CDS Start-End: 113-388
agtggcggccggtaccctggtccctgcaccggagcggggtggccggccgcgggggcaccgcagcgcggggctggaacactgagggccgagcccgcagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttac

SEQ ID NO: 169141 - DNA, 636 bp, Homo sapiens
  Payload ID: 13293
  Gene Symbol: PFN2
  Gene Name: profilin 2
  ENST ID: ENST00000489155
  CDS Start-End: 188-463
cgccgcggaaggatcgcacgcacgcgcgcgcgcacgcccagccgtgtccgcggaaaacggagggcgctgcggtaaggagcagccgccacaggcacagccgcttcgcagcctcccgccgctggtttgtcagccccgcggctgcgggcggccgggcggccgagcgcgctctgagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctcc

SEQ ID NO: 169142 - DNA, 530 bp, Homo sapiens
  Payload ID: 13294
  Gene Symbol: PFN3
  Gene Name: profilin 3
  Uniprot ID: P60673
  ENST ID: ENST00000358571
  CDS Start-End: 61-474
cgcgtggcgcctctatatttccccgagaggtgcgaggcggctgggcgcactcggagcgcgatgggcgactggaaggtctacatcagtgcagtgctgcgggaccagcgcatcgacgacgtggccatcgtgggccatgcggacaacagctgcgtgtgggcttcgcggcccgggggcctgctggcggccatctcgccgcaggaggtgggcgtgctcacggggccggacaggcacaccttcctgcaggcgggcctgagcgtggggggccgccgctgctgcgtcatccgcgaccacctgctggccgagggtgacggcgtgctggacgcacgcaccaaggggctggacgcgcgcgccgtgtgcgtgggccgtgcgccgcgcgcgctcctggtgctaatgggccgacgcggcgtacatgggggcatcctcaacaagacggtgcacgaactcatacgcgggctgcgcatgcagggcgcctagccggccagccaggccgcccactggtagcgcgggccaaataaactgtgacctgggcg

SEQ ID NO: 169143 - DNA, 974 bp, Homo sapiens
  Payload ID: 13295
  Gene Symbol: PFN4
  Gene Name: profilin family, member 4
  Uniprot ID: Q8NHR9
  ENST ID: ENST00000313213
  CDS Start-End: 373-762
agcgagtccgcgcgggcggtgccggggcggcggaggacggcttcaggcccaaaggggattgggcggcggctctaggtggcgggtcttggtttgcggaaggggctggagtcgctgcttctcggtgaccggcgcgtggcccggccaatcctgccgccgccacccacccgcaaccgcgtccgttgacggtcgggtccttggtcgccgggtccttgcgggcaccacagagcggggtggcgtccgctccctcgagtcctcggtgccagggaattcaccgctcaccaccccctgccccgccttgggtcctgctcggggaccaaaccactggaaggcagtggcgggaaacgggcgcctgtgccggagagttgagggaacatgagccatttgcagagcttattgttagacaccctcttgggaaccaagcatgtggacagtgcagccctcatcaaaatccaggagcggagcttgtgtgtagcatcaccaggtttcaatgtaacgcccagtgatgtccgaacactggtgaatggatttgccaagaaccctttgcaagcccgaagagaaggactgtatttcaagggaaaagattacagatgtgtccgggcagatgaatattctctttatgccaaaaatgagaacactggtgtggttgtcgtgaagacccatctgtatcttctggtagcaacttacactgagggcatgtatcctagcatctgtgtggaagccacagagagcctgggagactacctaagaaaaaaaggaagttaagtcatcagaggcccatgaaagacaattttattattttagaagaaaattgaagagcctaaagaaaaaatattttatggttgaaaaaacactagacagaaggcactaaaaaagaagaatgaattaagggagcaatttttattacttccagagatcctcttctttcactggaattacttgatcaactgttttttaataagtgttggtcatcggca

SEQ ID NO: 169144 - DNA, 470 bp, Homo sapiens
  Payload ID: 13295
  Gene Symbol: PFN4
  Gene Name: profilin family, member 4
  ENST ID: ENST00000436622
  CDS Start-End: 442-470
gggcggtgccggggcggcggaggacggcttcaggcccaaaggggattgggcggcggctctaggtggcgggtcttggtttgcggaaggggctggagtcgctgcttctcggtgaccggcgcgtggcccggccaatcctgccgccgccacccacccgcaaccgcgtccgttgacggtcgggtccttggtcgccgggtccttgcgggcaccacagagcggggtggcgtccgctccctcgagtcctcggtgccagggaattcaccgctcaccaccccctgccccgccttgggtcctgctcggggaccaaaccactggaaggcagtggcgggaaacgggcgcctgtgccggagataatcctgatgtaaaccattgacatagccagaaaatcaccaggctgtgattttccaaactcagcttcataacctattctgtagttgagggaacatgagccatttgcagagcttattgttaga

SEQ ID NO: 169145 - DNA, 480 bp, Homo sapiens
  Payload ID: 13296
  Gene Symbol: PGC
  Gene Name: progastricsin (pepsinogen C)
  ENST ID: ENST00000356667
  CDS Start-End: 62-480
tccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaaccagcaggg

SEQ ID NO: 169146 - DNA, 1371 bp, Homo sapiens
  Payload ID: 13296
  Gene Symbol: PGC
  Gene Name: progastricsin (pepsinogen C)
  Uniprot ID: P20142
  ENST ID: ENST00000373025
  CDS Start-End: 64-1230
actccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaaccagcagggctccagcgggggagcggttgtctttgggggtgtggatagcagcctgtacacggggcagatctactgggcgcctgtcacccaggaactctactggcagattggcattgaagagttcctcatcggcggccaggcctccggctggtgttctgagggttgccaggccatcgtggacacaggcacctctctgctcactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttcttta

SEQ ID NO: 169147 - DNA, 399 bp, Homo sapiens
  Payload ID: 13296
  Gene Symbol: PGC
  Gene Name: progastricsin (pepsinogen C)
  ENST ID: ENST00000415707
  CDS Start-End: 142-399
agagagaagagagggcaaagcaaagagaagcaggaatgagaaatggagaaagggtcctggtagtgtttgcatctcagattctagctgatcctaaggctccaccctatccctccccttcctgaagctgggctgccctgcgaaatgtgccttcatccatccagtacacctcctttccaccaacccagaaaggaagcagtcatctgcaagcaaagagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactcca

SEQ ID NO: 169148 - DNA, 1152 bp, Homo sapiens
  Payload ID: 13296
  Gene Symbol: PGC
  Gene Name: progastricsin (pepsinogen C)
  Uniprot ID: P20142
  ENST ID: ENST00000425343
  CDS Start-End: 68-1015
cttcactccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaacctggtcctggagtcttctggtctaggtccactgctgacccctagcagagcagctccacccagctccacactccagctaccagagaagcctctggaacaaacatggaatatccttacccccttcaccaagaccctacctgtctccaatctcagcagaaaagtaacaagctgggccggggtggggatcccggtgacatgtctaccagaggcaggaagcggaggggagaggagagcagagtgtgggctgggggtcccaaccactaggggaccccccagaagtcagcatcattcgggagcctgaggcgctgggaattccaaggcctggccagaaagccccagtctaagggacgcatcccagtccccagggagccccaatctaagggatacagccccatcctcagggagccccagtctgagggagacacagactcgtcctca

SEQ ID NO: 169149 - DNA, 821 bp, Homo sapiens
  Payload ID: 13297
  Gene Symbol: PAEP
  Gene Name: progestagen-associated endometrial protein
  Uniprot ID: P09466
  ENST ID: ENST00000277508
  CDS Start-End: 26-568
ctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 169150 - DNA, 851 bp, Homo sapiens
  Payload ID: 13297
  Gene Symbol: PAEP
  Gene Name: progestagen-associated endometrial protein
  Uniprot ID: P09466
  ENST ID: ENST00000371766
  CDS Start-End: 36-578
ggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctgggtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 169151 - DNA, 826 bp, Homo sapiens
  Payload ID: 13297
  Gene Symbol: PAEP
  Gene Name: progestagen-associated endometrial protein
  ENST ID: ENST00000433563
  CDS Start-End: 1-394
tgtcccggccatggacatcccccagaccaagcaggacctggagctcccaaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactgcaaggcctctggagctccccagctctcatggaagccccaggggcccaggactgacccagcctcttccacagccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgtcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaacaaaagggtccactttcacaaa

SEQ ID NO: 169152 - DNA, 575 bp, Homo sapiens
  Payload ID: 13297
  Gene Symbol: PAEP
  Gene Name: progestagen-associated endometrial protein
  ENST ID: ENST00000457014
  CDS Start-End: 1-100
tgagatcatgcagggattcatcagggctttcaggcccctgcccaggcacctatggtacttgctggacttgaaacagatggaagagccgtgccgtttctagatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccgctttagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtc

SEQ ID NO: 169153 - DNA, 465 bp, Homo sapiens
  Payload ID: 13297
  Gene Symbol: PAEP
  Gene Name: progestagen-associated endometrial protein
  ENST ID: ENST00000418284
  CDS Start-End: 1-399
ctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggatggagtctcgctctgtcaccaggctggagtgcagtg

SEQ ID NO: 169154 - DNA, 629 bp, Homo sapiens
  Payload ID: 13297
  Gene Symbol: PAEP
  Gene Name: progestagen-associated endometrial protein
  ENST ID: ENST00000454923
  CDS Start-End: 1-379
ccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctagtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgtcctgtc

SEQ ID NO: 169155 - DNA, 990 bp, Homo sapiens
  Payload ID: 13297
  Gene Symbol: PAEP
  Gene Name: progestagen-associated endometrial protein
  Uniprot ID: P09466
  ENST ID: ENST00000479141
  CDS Start-End: 45-587
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgtcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaacaaaagggtccactttcacaaa

SEQ ID NO: 169156 - DNA, 838 bp, Homo sapiens
  Payload ID: 13297
  Gene Symbol: PAEP
  Gene Name: progestagen-associated endometrial protein
  ENST ID: ENST00000371768
  CDS Start-End: 47-556
agcatccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 169157 - DNA, 729 bp, Homo sapiens
  Payload ID: 13297
  Gene Symbol: PAEP
  Gene Name: progestagen-associated endometrial protein
  ENST ID: ENST00000611414
  CDS Start-End: 45-476
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 169158 - DNA, 3154 bp, Homo sapiens
  Payload ID: 13298
  Gene Symbol: PIBF1
  Gene Name: progesterone immunomodulatory binding factor 1
  Uniprot ID: Q8WXW3
  ENST ID: ENST00000326291
  CDS Start-End: 339-2612
gtggcctaggcggggcttccttctggacgccacctcacaacgtgtgttgctttccgctcctcggaacatccgggagagttgacttccggcggcttgtgggagtgctggttctgtcctccttgcgggtgcggagatggttgtcttggttacgggtcctaacggtcccctgccttgaaatcccttgttgagggcctgcaaccttgtgcttccgaccggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatggaaaacaaaattcagcttaatcgtgtactcagcattttttaaataacaatgtttatttgaactaatattaaattaacaaattcagtgtaatcaaaatgtgtaaagaacaatcaatatactttatttttttttctattttataaaataaatatatatgctatgctttaaattttggagctttcataaatgttcaatgcattttaagtgtgtggcttataaatattttggtatttttctatactacgtaaattctgagtttaaatgtcatacacaaatactaagacactttgcatttttaaaaattaagaatcatttgtgaagtccactacgaggtacttcaaaagcccagtaatggtggtcagataccatgtagatggatacagattgttgactcttttgaagttgtttttttcttatattttatattaccattaaccaataaaatctggcagaaagtctgctattccattggtaaagtgaaaa

SEQ ID NO: 169159 - DNA, 2882 bp, Homo sapiens
  Payload ID: 13298
  Gene Symbol: PIBF1
  Gene Name: progesterone immunomodulatory binding factor 1
  ENST ID: ENST00000617689
  CDS Start-End: 258-2354
acttccggcggcttgtgggagtgctggttctgtcctccttgcgggtgcggagatggttgtcttggttacgggtcctaacggtcccctgccttgaaatcccttgttgagggcctgcaaccttgtgcttccgaccggagacgcctttggtccctcggtgtctgcactggctgctggtcaaggcttcagtgtggagtaattgacactttcgagaatattaaaatcaaattagagaagaaaactgatccataataataaaaatgtctcgaaaaatttcaaaggagtcaaaaaaagtgaacatctctagttctctggaatctgaagatattagtttagaaacaacagttcctacggatgatatttcctcatcagaagagcgagagggcaaagtcagaatcaccaggcagctaattgaacgaaaagaactacttcataatattcagttactaaaaattgagctatcccagaaaactatgatgatcgacaatttgaaagtggattatcttacaaagattgaagaattggaggagaaacttaatgatgcacttcaccagaagcagctactaacattgagattagacaaccaattggcttttcaacagaaagatgccagcaaatatcaagaattaatgaaacaagaaatggaaaccattttgttgagacagaaacaactagaagagacaaatcttcagctaagagaaaaagctggagatgttcgtcgaaacctgcgtgactttgagttgacagaagagcaatatattaaattaaaagcttttcctgaagatcagctttctattcctgaatatgtatctgttcgcttctatgagctagtgaatccattaagaaaggaaatctgtgaactacaagtgaaaaagaatatcctagcagaagaattaagtacaaacaaaaaccaactgaagcagctgacagagacatatgaggaagatcgaaaaaactactctgaagttcaaattagatgtcaacgtttggccttagaattagcagacacaaaacagttaattcagcaaggtgactaccgtcaagagaactatgataaagtcaagagtgaacgtgatgcacttgaacaggaagtaattgagcttaggagaaaacatgaaatacttgaagcctctcacatgattcaaacaaaagaacgaagtgaattatcaaaagaggtagtcaccttagagcaaactgttactttactgcaaaaggataaagaatatcttaatcgccaaaacatggagcttagtgttcgctgtgctcatgaagaggatcgccttgaaagacttcaagctcaactggaagaaagcaaaaaggctagagaagagatgtatgaaaaatatgtagcatccagagaccattataaaacagaatatgaaaataaactacatgatgaactagaacaaatcagattgaaaaccaaccaagaaattgatcaacttcgaaatgcctctagggaaatgtatgaacgagaaaacagaaatctccgagaagcaagggataatgctgtggctgaaaaggaacgagcagtgatggctgaaaaggatgctttagaaaaacacgatcagctcttagacaggtacagagaactacaacttagtacagaaagcaaagtaacagaatttctccatcaaagtaaattaaaatcttttgaaagtgagcgtgttcaacttctgcaagaggaaacagcaagaaatctcacacagtgtcaattggaatgtgaaaaatatcagaaaaaattggaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggtatttttcctattttgtcataattgtaatcattttaggcttttttaaaaactgctatcaggttaaaattattggatcccagttgtgcatgttcattaatgacttctcttatttatgtctcactgtaattttgtccttttttattcaacttttgatatacttcttagagttaattcttattcctagaataaccccttcttgttgtgttgatatctgtcactgaatttccccatattatttaataataatctgttttatcttattctgcaactagacagttaatttccttagtgtgcctctcgtcttctttatcaatgtatgcccagtgcctgtagtgtagataatttgtgttgagctttaaagttcataaaattattttcttttcttcatttgttccctaccaaaattcttttagagtaaatataattcctattttatagatggagaaatgagttttaagtggcttgcccatggcagttagtaactaagagataagttctgttttgttttgtttttttcctttaaggtttattgagttataatctacaaagaataaaattaaccttttttagcaga

SEQ ID NO: 169160 - DNA, 1098 bp, Homo sapiens
  Payload ID: 13298
  Gene Symbol: PIBF1
  Gene Name: progesterone immunomodulatory binding factor 1
  Uniprot ID: Q8WXW3
  ENST ID: ENST00000615625
  CDS Start-End: 387-1037
ctgccttgaaatcccttgttgagggcctgcaaccttgtgcttccgaccggagacgcctttggtccctcggtgtctgcactggctgctggtcaaggcttcagtgtggagtaattgacactttcgagagaccattataaaacagaatatgaaaataaactacatgatgaactagaacaaatcagattgaaaaccaaccaagaaattgatcaacttcgaaatgcctctagggaaatgtatgaacgagaaaacaggttttaaccaaagaattttatagtctccaagcctcttctgaaaaacgcattactgaacttcaagcacagaactcagagcatcaagcaaggctagacatttatgagaaactggaaaaagagcttgatgaaataataatgcaaactgcagaaattgaaaatgaagatgaggctgaaagggttcttttttcctacggctatggtgctaatgttcccacaacagccaaaagacgactaaagcaaagtgttcacttggcaagaagagtgcttcaattagaaaaacaaaactcgctgattttaaaagatctggaacatcgaaaggaccaagtaacacagctttcacaagagcttgacagagccaattcgctattaaaccagactcaacagccttacaggtatctcattgaatcagtgcgtcagagagattctaagattgattcactgacggaatctattgcacaacttgagaaagatgtcagcaacttaaataaagaaaagtcagctttactacagacgaagaatcaaatggcattagatttagaacaacttctaaatcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacactctttactaaaaaagaagcacctgagtggtctaagaaacaaaagatgaagacctagtgttttggatgggaagcacctgtagaccattatatactcctgaagttctttttctgatgga

SEQ ID NO: 169161 - DNA, 2496 bp, Homo sapiens
  Payload ID: 13299
  Gene Symbol: PGR
  Gene Name: progesterone receptor
  Uniprot ID: P06401
  ENST ID: ENST00000263463
  CDS Start-End: 1-2496
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtga

SEQ ID NO: 169162 - DNA, 13748 bp, Homo sapiens
  Payload ID: 13299
  Gene Symbol: PGR
  Gene Name: progesterone receptor
  Uniprot ID: P06401
  ENST ID: ENST00000325455
  CDS Start-End: 1455-4256
ggatccattttataagctcaaagataattacttttcagactaagaatatttagggtaaaaagtactgttcaacatctctactgaggatgttatgatgtagcacactgtataagctggagctaaaggaaactttccttaaagtgctatttactaaaaattggaacacattccttaagacaaatcgaagtgtggcacacaacatccaaacttccatcatagatacagaggtgttaccatctcccactcccaaatttctttgtcacgctgaggatactcaagaggagcaggacatgttggtcgcagcaggagaaacttgaaagcattcacttttatggaactcataagggagagaatctcttatttagtatcgtccttgatacatttattattttaaaagataatgtagccaaatgtcttcctctgtgttaaatctttacaaaactgaaatcttaaaatggtgacaaaaattctacttctgatagaatctattcatttttccaattagatagggcataattcttaatttgcaaaacaaaacgtaatatgcttatgaggttccatcccaaagaacctgctattgagagtagcattcagaataacgggtggaaatgccaactccagagtttcagatcctaccggtaattggggtagggaggggctttgggcggggcctccctagaggaggaggcgttgttagaaagctgtctggccagtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggtatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatgcaaatagtattgtgggttttgtaggtttttaaaataaccttttttggggagagaattgtcctctaatgaggtattgcgagtggacataagaaatcagaagattatggcctaactgtactccttaccaactgtggcatgctgaaagttagtcactcttactgattctcaattctctcacctttgaaagtagtaaaatatctttcctgccaattgctcctttgggtcagagcttattaacatcttttcaaatcaaaggaaagaagaaagggagaggaggaggagggaggtatcaattcacatacctttctcctctttatcctccactatcatgaattcatattatgtttcagccatgcaaatctttttaccatgaaatttcttccagaattttccccctttgacacaaattccatgcatgtttcaaccttcgagactcagccaaatgtcatttctgtaaaatcttccctgagtcttccaagcagtaatttgccttctcctagagtttacctgccattttgtgcacatttgagttacagtagcatgttattttacaattgtgactctcctgggagtctgggagccatataaagtggtcaatagtgtttgctgactgagagttgaatgacattttctctctgtcttggtattactgtagatttcgatcattctttggttacatttctgcatatttctgtacccatgactttatcactttcttctcccatgctttatctccatcaattatcttcattacttttaaattttccacctttgcttcctactttgtgagatctctccctttactgactataacatagaagaatagaagtgtattttatgtgtcttaaggacaatactttagattccttgttctaagtttttaaactgaatgaatggaatattatttctctccctaagcaaaattccacaaaacaattatttcttatgtttatgtagccttaaattgttttgtactgtaaacctcagcataaaaactttcttcatttctaatttcattcaacaaatattgattgaatacctggtattagcacaagaaaaatgtgctaataagccttatgagaatttggagctgaagaaagacatataactcaggaaagttacagtccagtagtaggtataaattacagtgcctgataaataggcattttaatatttgtacactcaacgtatactaggtaggtgcaaaacatttacatataattttactgatacccatgcagcacaaaggtactaactttaaatattaaataacacctttatgtgtcagtaattcatttgcattaaatcttattgaaaaggctttcaatatattttccccacaaatgtcatcccaagaaaaaagtatttttaacatctcccaaatataatagttacaggaaatctacctctgtgagagtgacacctctcagaatgaactgtgtgacacaagaaaatgaatgtaggtctatccaaaaaaaaccccaagaaacaaaaacaatattattagccctttatgcttaagtgatggactcagggaacagttgatgttgtgatcattttattatctgattcttgttactttgaattaaaccaatattttgatgatataaatcatttccaccagcatatatttaatttccataataactttaaaattttctaatttcactcaactatgagggaatagaatgtggtggccacaggtttggcttttgttaaaatgtttgatatcttcgatgttgatctctgtctgcaatgtagatgtctaaacactaggatttaatatttaaggctaagctttaaaaataaagtacctttttaaaaagaatatggcttcaccaaatggaaaatacctaatttctaaatctttttctctacaaagtcctatctactaatgtctccattactatttagtcatcataaccattatcttcattttacatgtcgtgttctttctggtagctctaaaatgacactaaatcataagaagacaggttacatatcaggaaatacttgaaggttactgaaatagattcttgagttaatgaaaatattttctgtaaaaaggtttgaaaagccatttgagtctaaagcattatacctccattatcagtagttatgtgacaattgtgtgtgtgtttaatgtttaaagatgtggcactttttaataaggcaatgctatgctattttttcccatttaacattaagataatttattgctatacagatgatatggaaatatgatgaacaatattttttttgccaaaactatgccttgtaagtagccatggaatgtcaacctgtaacttaaattatccacagatagtcatgtgtttgatgatgggcactgtggagataactgacataggactgtgccccccttctctgccacttactagctggatgagattaagcaagtcatttaactgctctgattaaacctgcctttcccaagtgctttgtaatgaatagaaatggaaaccaaaaaaaacgtatacaggccttcagaaatagtaattgctactattttgttttcattaagccatagttctggctataattttatcaaactcaccagctatattctacagtgaaagcaggattctagaaagtctcactgttttatttatgtcaccatgtgctatgatatatttggttgaattcatttgaaattagggctggaagtattcaagtaatttcttctgctgaaaaaatacagtgttttgagtttagggcctgttttatcaaagttctaaagagcctatcactcttccattgtagacattttaaaataatgacactgattttaacatttttaagtgtctttttagaacagagagcctgactagaacacagcccctccaaaaacccatgctcaaattatttttactatggcagcaattccacaaaagggaacaatgggtttagaaattacaatgaagtcatcaacccaaaaaacatccctatccctaagaaggttatgatataaaatgcccacaagaaatctatgtctgctttaatctgtcttttattgctttggaaggatggctattacatttttagtttttgctgtgaatacctgagcagtttctctcatccatacttatccttcacacatcagaagtcaggatagaatatgaatcattttaaaaacttttacaactccagagccatgtgcataagaagcattcaaaacttgccaaaacatacattttttttcaaatttaaagatactctatttttgtattcaatagctcaacaactgtggtccccactgataaagtgaagtggacaaggagacaagtaatggcataagtttgtttttcccaaagtatgcctgttcaatagccattggatgtgggaaatttctacatctcttaaaattttacagaaaatacatagccagatagtctagcaaaagttcaccaagtcctaaattgcttatccttacttcactaagtcatgaaatcattttaatgaaaagaacatcacctaggttttgtggtttctttttttcttattcatggctgagtgaaaacaacaatctctgtttctccctagcatctgtggactatttaatgtaccattattccacactctatggtccttactaaatacaaaattgaacaaaaagcagtaaaacaactgactcttcacccatattataaaatataatccaagccagattagtcaacatccataagatgaatccaagctgaactgggcctagattattgagttcaggttggatcacatccctatttattaataaacttaggaaagaaggccttacagaccatcagttagctggagctaatagaacctacacttctaaagttcggcctagaatcaatgtggccttaaaagctgaaaagaagcaggaaagaacagttttcttcaataatttgtccaccctgtcactggagaaaatttaagaatttgggggtgttggtagtaagttaaacacagcagctgttcatggcagaaattattcaatacataccttctctgaatatcctataaccaaagcaaagaaaaacaccaaggggtttgttctcctccttggagttgacctcattccaaggcagagctcaggtcacaggcacaggggctgcgcccaagcttgtccgcagccttatgcagctgtggagtctggaagactgttgcaggactgctggcctagtcccagaatgtcagcctcattttcgatttactggctcttgttgctgtatgtcatgctgaccttattgttaaacacaggtttgtttgctttttttccactcatggagacatgggagaggcattatttttaagctggttgaaagctttaaccgataaagcatttttagagaaatgtgaatcaggcagctaagaaagcatactctgtccattacggtaaagaaaatgcacagattattaactctgcagtgtggcattagtgtcctggtcaatattcggatagatatgaataaaatatttaaatggtattgtaaatagttttcaggacatatgctatagcttatttttattatcttttgaaattgctcttaatacatcaaatcctgatgtattcaatttatcagatataaattattctaaatgaagcccagttaaatgtttttgtcttgtcagttatatgttaagtttctgatctctttgtctatgacgtttactaatctgcatttttactgttatgaattattttagacagcagtggtttcaagctttttgccactaaaaataccttttattttctcctcccccagaaaagtctataccttgaagtatctatccaccaaactgtacttctattaagaaatagttattgtgttttcttaatgttttgttattcaaagacatatcaatgaaagctgctgagcagcatgaataacaattatatccacacagatttgatatattttgtgcagccttaacttgatagtataaaatgtcattgctttttaaataatagttagtcaatggacttctatcatagctttcctaaactaggttaagatccagagctttggggtcataatatattacatacaattaagttatctttttctaagggctttaaaattcatgagaataaccaaaaaaggtatgtggagagttaatacaaacataccatattcttgttgaaacagagatgtggctctgcttgttctccataaggtagaaatactttccagaatttgcctaaactagtaagccctgaatttgctatgattagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcgtggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatgatcataaacatgaagaattgtaggtgatcatgacctcctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccaggtcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagcctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccgttgcttattagtaaaactagtgttaatacttggcaagagatgcagggaatctttctcatgactcacgccctatttagttattaatgctactaccctattttgagtaagtagtaggtccctaagtacattgtccagagttatacttttaaagatatttagccccatatacttcttgaatctaaagtcatacaccttgctcctcatttctgagtgggaaagacatttgagagtatgttgacaattgttctgaaggtttttgccaagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttcta

SEQ ID NO: 169163 - DNA, 2750 bp, Homo sapiens
  Payload ID: 13299
  Gene Symbol: PGR
  Gene Name: progesterone receptor
  ENST ID: ENST00000534780
  CDS Start-End: 1-2412
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtga

SEQ ID NO: 169164 - DNA, 2633 bp, Homo sapiens
  Payload ID: 13299
  Gene Symbol: PGR
  Gene Name: progesterone receptor
  ENST ID: ENST00000528960
  CDS Start-End: 1-2295
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtga

SEQ ID NO: 169165 - DNA, 1901 bp, Homo sapiens
  Payload ID: 13299
  Gene Symbol: PGR
  Gene Name: progesterone receptor
  Uniprot ID: P06401
  ENST ID: ENST00000534013
  CDS Start-End: 446-1465
atttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggtatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaat

SEQ ID NO: 169166 - DNA, 2365 bp, Homo sapiens
  Payload ID: 13299
  Gene Symbol: PGR
  Gene Name: progesterone receptor
  ENST ID: ENST00000526300
  CDS Start-End: 1-2088
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggttttcgaaacttacatattgatgaccagataactctcattcagtattcttggatgagcttaatggtgtttggtctaggatggagatcctacaaacacgtcagtgggcagatgctgtattttgcacctgatctaatactaaatgattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtga

SEQ ID NO: 169167 - DNA, 2816 bp, Homo sapiens
  Payload ID: 13299
  Gene Symbol: PGR
  Gene Name: progesterone receptor
  ENST ID: ENST00000617858
  CDS Start-End: 744-2816
agtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaggaaagtattgttacttcttaa

SEQ ID NO: 169168 - DNA, 3038 bp, Homo sapiens
  Payload ID: 13299
  Gene Symbol: PGR
  Gene Name: progesterone receptor
  ENST ID: ENST00000619228
  CDS Start-End: 744-3038
agtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaatcccacaggagtttgtcaagcttcaagttagccaagaagagttcctctgtatga

SEQ ID NO: 169169 - DNA, 551 bp, Homo sapiens
  Payload ID: 13299
  Gene Symbol: PGR
  Gene Name: progesterone receptor
  ENST ID: ENST00000632634
  CDS Start-End: 40-551
cccagtggggcagaaagtgcgcggcgagttgggggctttatgaaatgcttctttcttagaagaaggacgtttaccaggagtgcttgtcttggagaggagccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccaga

SEQ ID NO: 169170 - DNA, 1911 bp, Homo sapiens
  Payload ID: 13300
  Gene Symbol: PGRMC1
  Gene Name: progesterone receptor membrane component 1
  Uniprot ID: O00264
  ENST ID: ENST00000217971
  CDS Start-End: 112-699
tagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccacta

SEQ ID NO: 169171 - DNA, 1762 bp, Homo sapiens
  Payload ID: 13300
  Gene Symbol: PGRMC1
  Gene Name: progesterone receptor membrane component 1
  Uniprot ID: O00264
  ENST ID: ENST00000535419
  CDS Start-End: 120-551
tccccggctagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccact

SEQ ID NO: 169172 - DNA, 2767 bp, Homo sapiens
  Payload ID: 13301
  Gene Symbol: PGRMC2
  Gene Name: progesterone receptor membrane component 2
  Uniprot ID: O15173
  ENST ID: ENST00000296425
  CDS Start-End: 22-693
ggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagaaaaaattatgcggtctgttaagaaaaatgagtaatttgtgttttggacttgaaataaacagtgttctgtagataattcctcaa

SEQ ID NO: 169173 - DNA, 3785 bp, Homo sapiens
  Payload ID: 13301
  Gene Symbol: PGRMC2
  Gene Name: progesterone receptor membrane component 2
  Uniprot ID: O15173
  ENST ID: ENST00000520121
  CDS Start-End: 968-1711
actttttcacactagaatttcaaggtgtgagaggctaaaagacgtccaagtacatgaaacagaacctgcaaataagagtgaatgacgaatagaaagaccacctcaacctgtccacttccctacggccgcagaagttatgattcaaggaataatgagactctaaatcctttaaaattctacaagagcagcctttgccaaacccagcggggagtggctgctcggtgccagcgcgaggagcacgtagactgccgatgccagagaagcccggtgcgggttccgtgctttctctccgttccaggaagaccccagctcgtggccaaatcttcttgccgcttcccggtctgcgcgcctacgctgccggtttcccgacaaaagcgacggcgccctggtgaaaagcagacgcccctcatcggtttgcgccttgcagctcaactatgccccagcctcccacaagccacctgcccgcgtcctccgccaggcgtccagcccggacctgcccccgcggccgccaaggcgcacgtgaagctcccgggcggggggagcgcaaggaggcgggagtttgcggacgcgaacgcaggcctaggaagggaagcgattccagggcgcacgcgcagagcctggagactgggcggggcgtgcctcccgcaggggttacgaacgaaaggcgagcgcgtggcgctcaggagcccgcgcacgcgctgtggtctcgccccgcccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagaaaaaattatgcggtctgttaagaaaaatgagtaatttgtgttttggacttgaaataaacagtgttctgtagataattcctcaa

SEQ ID NO: 169174 - DNA, 2858 bp, Homo sapiens
  Payload ID: 13301
  Gene Symbol: PGRMC2
  Gene Name: progesterone receptor membrane component 2
  ENST ID: ENST00000394276
  CDS Start-End: 664-798
ctgaactagtcactgggaccacaaagatgatacagtctcttttctcatagaattacaaccttcataaggatagcagaaagaaaaatgttacagattcaagttcagctgagtctttacataatacatgatgttctgttgattatttttatttttttgatgccactattaacagcaaccagtaaacattatttcccctcaagcagactggcttctaaacctaaccacttaagtttcttcttctccctcattacctcacagtcttcattttgaatattaagtttggggatatctgaagtaattgaaattgagggttttaagatctaagtgaaaagctttacttgggtcaaaaggcagatttccaacaaatttcttttcttattccatctagtatctgtacatgttttgaaattaagggtatatacaaatgtgaattatgaggggtttttttctttgttgtgtttttttttttttttttttactttttcctttgagacattctaaaatattgttaggtgatctaaataatttattttcttttttccagcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagaaaaaattatgcggtctgttaagaaaaatgagtaatttgtgttttggacttgaaataaacagtgttctgt

SEQ ID NO: 169175 - DNA, 1028 bp, Homo sapiens
  Payload ID: 13301
  Gene Symbol: PGRMC2
  Gene Name: progesterone receptor membrane component 2
  ENST ID: ENST00000503872
  CDS Start-End: 283-417
gccactgatctccttttttccctcgctgtattactccgtaaggccacgtttaggggcatgtaaagtcccaaccctccagtctctgaagtccagacgtataagcaacacctcggactctctttaaaccagttttagttcggagttgctttccatgattaacaagcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttc

SEQ ID NO: 169176 - DNA, 1144 bp, Homo sapiens
  Payload ID: 13301
  Gene Symbol: PGRMC2
  Gene Name: progesterone receptor membrane component 2
  ENST ID: ENST00000512483
  CDS Start-End: 306-440
gggcggggcgtgcctcccgcaggggttacgaacgaaaggcgagcgcgtggcgctcaggagcccgcgcacgcgctgtggtctcgccccgcccatgagcgtccgcgcggccgtcgtagcatcttttcttcagacccgcccggctcgtctacttaacctagcggaggcttggagtgagagcagggaagtcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaa

SEQ ID NO: 169177 - DNA, 430 bp, Homo sapiens
  Payload ID: 13301
  Gene Symbol: PGRMC2
  Gene Name: progesterone receptor membrane component 2
  ENST ID: ENST00000509070
  CDS Start-End: 1-180
aagttctacggcccgggtgaggagttggaaggggaggggaaggaccccctgcagctgaagcacaacccccttcggacagggaggcctctgggcaccgggccacgtttaggggcatgtaaagtcccaaccctccagtctctgaagtccagacgtataagcaacacctcggactctctttaaaccagttttagttcggagttgctttccatgattaacaagcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaata

SEQ ID NO: 169178 - DNA, 818 bp, Homo sapiens
  Payload ID: 13301
  Gene Symbol: PGRMC2
  Gene Name: progesterone receptor membrane component 2
  ENST ID: ENST00000503588
  CDS Start-End: 98-373
agacgtataagcaacacctcggactctctttaaaccagttttagttcggagttgctttccatgattaacaaggtatgtgggatgagaacagaccagaatgcagagcttattaaagactgcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatggg

SEQ ID NO: 169179 - DNA, 3783 bp, Homo sapiens
  Payload ID: 13301
  Gene Symbol: PGRMC2
  Gene Name: progesterone receptor membrane component 2
  Uniprot ID: O15173
  ENST ID: ENST00000613358
  CDS Start-End: 961-1704
cacactagaatttcaaggtgtgagaggctaaaagacgtccaagtacatgaaacagaacctgcaaataagagtgaatgacgaatagaaagaccacctcaacctgtccacttccctacggccgcagaagttatgattcaaggaataatgagactctaaatcctttaaaattctacaagagcagcctttgccaaacccagcggggagtggctgctcggtgccagcgcgaggagcacgtagactgccgatgccagagaagcccggtgcgggttccgtgctttctctccgttccaggaagaccccagctcgtggccaaatcttcttgccgcttcccggtctgcgcgcctacgctgccggtttcccgacaaaagcgacggcgccctggtgaaaagcagacgcccctcatcggtttgcgccttgcagctcaactatgccccagcctcccacaagccacctgcccgcgtcctccgccaggcgtccagcccggacctgcccccgcggccgccaaggcgcacgtgaagctcccgggcggggggagcgcaaggaggcgggagtttgcggacgcgaacgcaggcctaggaagggaagcgattccagggcgcacgcgcagagcctggagactgggcggggcgtgcctcccgcaggggttacgaacgaaaggcgagcgcgtggcgctcaggagcccgcgcacgcgctgtggtctcgccccgcccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagaaaaaattatgcggtctgttaagaaaaatgagtaatttgtgttttggacttgaaataaacagtgttctgtagataattcctcaacttca

SEQ ID NO: 169180 - DNA, 2153 bp, Homo sapiens
  Payload ID: 13302
  Gene Symbol: PAQR3
  Gene Name: progestin and adipoQ receptor family member III
  ENST ID: ENST00000342820
  CDS Start-End: 171-1046
agtggccggtgtgagcgcagagccgggccctgggcagcagcggcagcgcggtaggacctcgcgcagcgtccgcgggctccggggcgggggcgccagcggcgaagccccctccccggggaggcgggacctgggggagctcccgagccggggagcggcggcggccgggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccagaaaatattttcagatggaaaataactaagaggacactgggtggagtgaacaacagtctccaaaacctgtatttgcttgtttgagaactttagctctggagtcagactgcttgggttcaagacccacatcaaccactttctagttacgtgggctaaaatcacttccacggtgaatcagagaagggattgtaccactcgtcacgtgtgttgggaaagaagaaagggtgagaaaccctggcctaaacaatccatcccacagatcctcaggcattcctttgtgtacttggtttttcaccactgagctttaaataagaatggaaatacaagggaaaacctgcgttgtaaacatgaggatttgggaacagatctaggacatgccactgaattgaagaccacccatcttccaggcagggccagaattacagaaaacaattctggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattagaatcaggaacgaagattcagggaatgtctgtcacatcttatggcatcccacctggacagaatatccgatttgaagattgtgattgacttccgtaaaactgtacaactctccatttggcagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacaggtacctcctgctgaggaaaagttaggttccaggctgcaagttaccacaatccaagataaccaaacaagtctgaatgttgaaaagctgttcaatgtactcagcagaaatcctaaacactcaattcttcttttggctttacattttgatgatgttacatgtgtaacttgcctgaatgagaaatgaaaggaacagaaccaaaaggatcttctggaggatggttatgtggagcagaaagtgagtctacattcttatctgaggatgctctctcctcgagcctatctgcaaaaataagatgaaacgaaataaaaaatgaaatgaaataaaaa

SEQ ID NO: 169181 - DNA, 3995 bp, Homo sapiens
  Payload ID: 13302
  Gene Symbol: PAQR3
  Gene Name: progestin and adipoQ receptor family member III
  Uniprot ID: Q6TCH7
  ENST ID: ENST00000395594
  CDS Start-End: 180-989
gctggcggcagtggccggtgtgagcgcagagccgggccctgggcagcagcggcagcgcggtaggacctcgcgcagcgtccgcgggctccggggcgggggcgccagcggcgaagccccctccccggggaggcgggacctgggggagctcccgagccggggagcggcggcggccgggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccagaatcacttccacggtgaatcagagaagggattgtaccactcgtcacgtgtgttgggaaagaagaaagggtgagaaaccctggcctaaacaatccatcccacagatcctcaggcattcctttgtgtacttggtttttcaccactgagctttaaataagaatggaaatacaagggaaaacctgcgttgtaaacatgaggatttgggaacagatctaggacatgccactgaattgaagaccacccatcttccaggcagggccagaattacagaaaacaattctggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatgtccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattaaaatatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaata

SEQ ID NO: 169182 - DNA, 549 bp, Homo sapiens
  Payload ID: 13302
  Gene Symbol: PAQR3
  Gene Name: progestin and adipoQ receptor family member III
  ENST ID: ENST00000508599
  CDS Start-End: 8-214
gggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagacactatacaaggcatcggtaaaacagtgctgaacagaaccaacctggtataaaggtcaagccactcgtaggtgtgcagaagagacagtgaggcagggcatttaagcaggaaaaaagaagcaagacacactttcttagcactttctggacttgcaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctg

SEQ ID NO: 169183 - DNA, 9811 bp, Homo sapiens
  Payload ID: 13302
  Gene Symbol: PAQR3
  Gene Name: progestin and adipoQ receptor family member III
  Uniprot ID: Q6TCH7
  ENST ID: ENST00000512733
  CDS Start-End: 215-1150
agaggaggctgcgacgctgccgggtccgccgcggcgctggcggcagtggccggtgtgagcgcagagccgggccctgggcagcagcggcagcgcggtaggacctcgcgcagcgtccgcgggctccggggcgggggcgccagcggcgaagccccctccccggggaggcgggacctgggggagctcccgagccggggagcggcggcggccgggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccaggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatgtccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattaaaatatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaatatttttaactgctgcttgtcattctttgtaatacataacagctttaaaatcatattttagaatcaggaacgaagattcagggaatgtctgtcacatcttatggcatcccacctggacagaatatccgatttgaagattgtgattgacttccgtaaaactgtacaactctccatttggcaggtacctactagataatactttgccctgtattaaatgtcaaggggcaaagcctattcctgtgaattcctgctggttgctttgctgcattaggtccctgtccactgtaaatcatcattcctgggaattctacttctgcccaagtgtgtaaagaatcagctcacctattagagaaggggtagaaataccttctgtgtgcattatcacaataactgtgtttacactaaagaggtgtaaatacagtcctctgaaattttgtaccagaattcccaagtagtgtaatgagataatgatccagaactgaaactacccttaagaaaacatttttggaagggagaggtaaatagcagtagggggtttcttgtgaaaaattaacctccatccttaagagggctgaaatgaacagccaccaaggttctagtcctgctctataaaatctgagatcaaaatactacctaacctgcacataatctcaattgtgacaaccatctgaactatctcatttaatatgtaacaacaaatacaagctcaagctttcaatatgagaatattaactacatgttacatatgatgcttgacctgggcttccttaaaaaggtattcgttatccaaaataaatagctcaaattgcagcatatattcatctcaagtaactataactgaatttgaacagtaatacactgcaaactattctttgttaatagaacttttctaatcatttgtgttattttgctttgtaccattcattttcattaaaaagatacaaagcccctttttttcacataactttagataaatgttacaacttcagaaaaagttaattcataaaaataggatgaacctttccacaggctaccaaagactccagtttttggaataatacatattataaccttgatgccaagcttagtccatcaatccaataaataggttttctctttaatgtgtcatagcctcttttctgatataattgaggattacaatgttatttaagcaaataaccagtattaattcagccaaagatgttatcagttttaaagatttttaaaaatttataatgtggaagctgtaaaataagttattcagaaggcactacacaatattgtttttgccttactgtcatcactcgagtatcagtaattatgactcactgaaaaagtcgtgctattaagtgttcttgtggcaaaaactcttaagtcaaatgggttttcttacctaaattgtaaactctgagctccttaagaatagggatctaatcttagcaacttttctattccactagctgctacataataggtgcttaatgtttgtggtgtgaatgaaataactgaatttgaatagaagtttacatccaaaagtcataataagacaaataatgaaaaactccaaagtcactgattataaagaatatgcaatccatttgggatttattgcatttaaagaaaacagattaaaacaggtatgataaatacagtaagaaaataactttaaatttcaaacaaaacagtgaatcagggacagaattcagtcaaaaagaataagcagtgtaaaggcaataaagtaataaaatcagttagtgcttaattagatatggcaggggaaaaggggtgggagggggagactgagtctatctcataattgtttcccagctatatttgaggactgaagttactttagcaagtatgttttgtaacaagtagaaatacaataaagatgtaaatttgctttatttaaaggttaaagttatttgcttagtggtacataaaaggcttcagaaaattcaagtttaacaaaaaatggaagtgtaatcaaagaaagtgcacttaaagctgtttgccagcaattaaaaagtagcttctatacagcttctattagatgacttttcaatcacaaaaagagcatagtcataaaaacaattctttcaaaagtagcagtataaattttaaaataaaacaaaaataaccccaaatcatgaccctttgcattatcatctaccttattctcttagtagcttttgtaaaccctcactaggagtgaatgttctcttagatatgattgtggttgcaattccattttttaaaaattcacattaactccacagtagagagatgtgacatgcatgtgtgtacatatttttatcttaatatataaaacaccactgagtataaaagttctcaaataaactattcatcatttatggtattctcacagtagatatgtcatctcattctcacagtagactgtcaactcaataattggacctaaaataacaagtttgctaaaaagaaaaaaaaatgagaaaaaagtttactgcacattctaaatatattaaaaacaaatgtacccaagcgcctcaaaactagtgatattaatacacttgtaccttctaacagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacagggtaagactgaaagttgtgtctatttgcaaatccggataatgtcgtaactatacccaacacgtacacagggattggggtaagggaaaataattacactcctgaataaatgttctagtcagttaaattttcatccggcctacaacctttcctcctccacctattatacttaccatgcaatttttgtgtcttagcagatacattcttcaatgccataaaaagctgatctttttaatactaacattttactgacgtgatattaaaataagcaaatggtccactttttaaaggattattcaaaatcaacaagcattattaaagctgttaagaaacaactttggcctcaagatttttgctagcttcataataatttacttctcttagtgatgttcaagtataacaggtttagttataactacatcctaaagaagcacaggggacacccaaataatattagggaaaaaaaaccccaaatatatatatatatatatatttgcttagtggtacatatataataacctttcttccttccttaaaccagaattgaaccatcccataatagagccaaacttttattgagtgctgtgtgccaggtactgtgttaagcactttcacatatcttgggagctttattctcataattctcacaagggaataacctgagcatcagctgtgtggagtgacctacaccttgaccatgattctgggggatgatgaatgaaaatgcaaagtataaatctatactccttaggaaaatgcctctactacaacacaaaggaatctctccatttctatcctattgaacccccaattgaatcctgtatcttttctctgagctacaatcttgaaagaagaaagtcactgtgctgtgttataagaatgtaaatattttatgctgtcagttgtttcctcagaatttataagtcaaagggtctacatcagtgtcagaatcatttaaaattattcagtgtattgaaaagcaagtaaaactctaggtatttcatgtttacatctgaaggagacattagttcatcctctaccccttttctaaatgatgaaactcatgaggtctagcagagaccaaggactaatacaatcaagaagcatattgtgtacacctcaacagattttcattaaaaaaaattgtttgatacaaacctactgtagttcatgaatttactatgtgtaatcatcaactcttcacttttaaaagaaagtatcacttgaatctattttgtaaagtttttaaacatctacttgagcatttgcattagcagtattaatcaacctgagaatcagaaaaaaaaaaaaaggtgcaaacatatttgcctttggcacgaggacaagtaattggtgcagtccagctctaaataataatgtaatgcttggtctgcctctgctacattgtgattcacatattgcttccctatccacaaatctatatttgatttagcatataaaagaagggaaaaagcaataaaaagacaaatatgtggtttagttacatatactttgcttctttccaagttcagaactgtgaaaataggcaaatagcttatcccattggggcactataagagattcctaataaaattactcgtaaaatatactttgagatcgaagagagttaatttaaaatataaaaatcaaagagagtgccagttgatgagtttctactcctttctgtaaatagcattaactgttctagaaacttccaaatgttaatctgatagcgcagcacaattatatcttaaaatagtcatagacacaggaagcacagatactatattcacattaattcacatatgtaatctctatcattaaatgatttctataaaacctcaagtttctaattaggatttgtggtgtaaaaaaaggcaaattggtagctgggttcttttcagtaaagacacaatcaactagcagaattaagatgctagtccaccttatatgcattttaggatctggtatattagtgcagaggtacttgcagcaggatgcatgaatcctgcctttatataaggctttgtgggtgtcaccattctgtgcactttattaaaactactccaccccccaaaacctaataaaaataattgttgcttatgacttggggaatatttggtgaagttgctaataaagtacattgttaaatgcaacatgatttcacattgtaaatgtcttgaaaattcagtttccgctacatattttcttcataaaataaaatttttatacaacccttgtcctccaatttttccaataatctgctttattagggccatcacaataaaagtttggggcaagaagccatgcataaagtgtttctaaagtagtgaatgttttctgttctgtatctttttttcttcttataatttctttacaaatgtcagatatttctcttcatatttttgttctaggcttctgtgcgacgatagtccatttttttaatttgttttaactgacaaaaattatatatatttatcatgtataacattgttttggaatatgtaagttgtggaatagttaaattgagctaattacacattatttcatatgcttatcattagatattccattttaatggcacttgtttttaaaaatgaaacagagttttaggcacaatagtcagttacttctggctctgctttgtggagaaaggtgtatggactgaaatctctgcactctccagataataactttctaatgctttaagataactagattgtttttaactgtctggaaattaaaagagaccttaaaaaaaattcacaagtgtaactagtgtatgtagaaataaccctaattttagggatatgcacataaaaatgacattctgatatcaaaaataacagtttcactgtcccttctcagtggctacacacctagaaaggtgccatgtgctttcactggaagtaccacacttgcatttctgtgttgtgatgtcagtagcagaaacccttagttagagcttgcaatttagctcccttttctcctgaagaggaatcaagttactaccctgtagagatacttcattcttctatttggtttatttagaaatcacctattctgactgatctttaagaatgaatgctataaagagctaccaaattttctttcaaattcataaaactgttcacacttttttgaaacaggagttaatgccgagaatccatcagaagtatctactgtttagaaggaaatggagcagcaccaaatgggtctaattcgactggttgggactgttgggactgatgtggagtgatgctttgcaccacaagttctgtaaagggcacggcaccaaaatcatccattttcaatacatctgcactatggaatga

SEQ ID NO: 169184 - DNA, 3370 bp, Homo sapiens
  Payload ID: 13302
  Gene Symbol: PAQR3
  Gene Name: progestin and adipoQ receptor family member III
  Uniprot ID: Q6TCH7
  ENST ID: ENST00000515853
  CDS Start-End: 1-267
atgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccaggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattaggtatggccacctggtgaattcagttgttaagcaatatataatggggaattgtataccccactatttctaagattcccattagttttccctttttcctttttaatatgagtaatgctttataaaaatgggaaaaaaagtatacttaaggatctgtagtaataactgctttacaaaatccttaaaactactaatttgctgcttgtacagaaagtgaaaattagttggcaatcataagaaacatctgaataacaacgatgaatgggaaactagtgttgaaataggattcattttacttagcaccagcttaatttccttaggaagggctcatgtccattagaaaatggagtcatcttatgtgcttaattattttcagttaattgtcaagtttaagtgcctaatcaaggcaagtgttgtttcagcctatgcttaatgcaagctaggatagtgattttaaataatcactaaaatcactagatttaaataatcactaaaatgatttgtgagaaactggcacttcagatattatatcctttagctataggttcttctctccctaagaacattagatattttagttttccagaacaaaagctttaaacttctgcagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattaaaatatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaa

SEQ ID NO: 169185 - DNA, 2288 bp, Homo sapiens
  Payload ID: 13302
  Gene Symbol: PAQR3
  Gene Name: progestin and adipoQ receptor family member III
  Uniprot ID: Q6TCH7
  ENST ID: ENST00000511594
  CDS Start-End: 2-937
gatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaagtttgtttattttatctaatgagacagtaaacatctggagtcatttgctgggtttctttctcttcttcaccctgggaatatatgacatgacatctgtgttaccttcagcaagtgcgtccagagaagattttgtaatttgttctatttgtcttttctgcttccaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccaggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattagaatcaggaacgaagattcagggaatgtctgtcacatcttatggcatcccacctggacagaatatccgatttgaagattgtgattgacttccgtaaaactgtacaactctccatttggcaggagttaatgccgagaatccatcagaagtatctactgtttagaaggaaatggagcagcaccaaatgggtctaattcgactggttgggactgttgggactgatgtggagtgatgctttgcaccacaagttctgtaaagggcacggcaccaaaatcatccattttcaatacatctgcactatggaatgacccatgtagtgaattttgtcttggccgccctggcaggacagtattgtgatcagcacggatgtcgctcaggccctgatgtggagggtgccatgacaggtctggagaatggaagggcttggcaccgaaggggtccaacaggctctcctcaggttgtaagacattccccctatctttcccatcagtcagtgcaacactaatgttctccttggagtctgagatggttaaaaattcattgctactttgagagtctcggcggcccacttttttgtgcctgcgagccctctctggagtgcgataggtaggcttcaaagtcttctttgtgctagttggcgtgccatgatgccgcttcccattacttttggacatatcctgctttgtgcgcctttggcgagaggacagtttctgtaagctgcgctgtttgactttttgctgctggctccccgttatttcatcaaagggcacaagcccaaaaaggtcctcattgctttcacttttacttgttgatgtgaggaagggctgaaatggagtggagccaaatacatctacacttttgggataaccagggatagtatgtgcctcaggccccactgcatggcattcttgtacattcaccttcttgctaaaaggcgcctttgtgaatacatcaaattcctcctgctccagtcctgcagcaggaaacctgtgttgagggaggttcttttcattcttttcttgctggggctgttgagcacgcactgcaaagaaggggacagcgccaaatacatcaaactcctgtttgggagtctccactgcaacatcagaggataattgggctgaggtgaggagtattgtattaagatcttgggttggtccactgccagatctgtctctgtagacagagctcatgtcactgtactttgctttagcctgctcataatcagaatcagagctatgtttctcctcttcttcctcatcttcagaatccatgaggagaggcctatgacccagattttctggttcagtatcatcatcattaaaatctccttgttccccctgaagaa

SEQ ID NO: 169186 - DNA, 1431 bp, Homo sapiens
  Payload ID: 13302
  Gene Symbol: PAQR3
  Gene Name: progestin and adipoQ receptor family member III
  Uniprot ID: Q6TCH7
  ENST ID: ENST00000512760
  CDS Start-End: 136-402
agcagcggcagcgcggtaggacctcgcgcagcgtccgcgggctccggggcgggggcgccagcggcgaagccccctccccggggaggcgggacctgggggagctcccgagccggggagcggcggcggccgggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaaggtctgtatgctttgctctgtgggctatcatcttttttcctgccatcggtcagaaaaaacatgtcgaagatggatggcattagattatgcaggaatttctattggaatactgggctgctatgtctcaggagtattttacgcattttattgtaataactactggcgtcaggtgtacttgatcacagtgcttgctatgatcctggcagtgttctttgcgcagattcatcccaattacctcacgcagcaatggcaaaggctccgttctatcatcttttgttctgtttcgggatatggagtgattcctactcttcactgggtttggctcaatggaggaattggtgctcctattgtacaggactttgcaccccgtgtaattgtgatgtatatgattgctcttcttgctttcctattctacatttccaaagtcccagagcggtactttccaggacaactaaactacctcggatcaagccaccaaatatggcatatccttgcagtagtgatgttatattggtggcatcagtcaacagtgtatgtcatgcagtacagacatagcaagccttgtcctgactatgtttcacatttgtgaattagaatcaggaacgaagattcagggaatgtctgtcacatcttatggcatcccacctggacagaatatccgatttgaagattgtgattgacttccgtaaaactgtacaactctccatttggcagtgcttacgtgaagtaccaaaacctaaaataaaccaagcagagtagctgacttgtaagaaaactgctctgcctggtgaacttcagcatagaagagtgggctccaccttagattttccaccagcaagaggacaacagtctatcactcttaaacaataaacaggtacctcctgctgaggaaaagttaggttccaggctgcaagttaccacaatccaagtgatgatgttacatgtgtaacttgcctgaatgagaaatgaaaggaacagaaccaaaaggatcttctggaggatggttatgtggagcagaaagtgagtctacattcttatctgaggatgctctctcctcgagcctatctgcaaaaataagatgaaacgaaataaaaaatgaaatgaaataaaaa

SEQ ID NO: 169187 - DNA, 2644 bp, Homo sapiens
  Payload ID: 13303
  Gene Symbol: PAQR4
  Gene Name: progestin and adipoQ receptor family member IV
  Uniprot ID: Q8N4S7
  ENST ID: ENST00000293978
  CDS Start-End: 406-1110
ccggccggcgggaactaggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgt

SEQ ID NO: 169188 - DNA, 2793 bp, Homo sapiens
  Payload ID: 13303
  Gene Symbol: PAQR4
  Gene Name: progestin and adipoQ receptor family member IV
  Uniprot ID: Q8N4S7
  ENST ID: ENST00000318782
  CDS Start-End: 431-1252
aggagcccggcgcgcgaaacgctggccggccggcgggaactaggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaagcctt

SEQ ID NO: 169189 - DNA, 869 bp, Homo sapiens
  Payload ID: 13303
  Gene Symbol: PAQR4
  Gene Name: progestin and adipoQ receptor family member IV
  ENST ID: ENST00000574988
  CDS Start-End: 215-835
gataagtaaccagtgccaaaagccttttgcccagggcctgtctctggccaaggccaggccgccaactggatgacagcattacctggacctgtcttgccctgtcctgtgttgtgtctgaaccgtggtccccttgaggatgtgactgaaactatctggtagatgactgtctccctccctagggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctccta

SEQ ID NO: 169190 - DNA, 2251 bp, Homo sapiens
  Payload ID: 13303
  Gene Symbol: PAQR4
  Gene Name: progestin and adipoQ receptor family member IV
  ENST ID: ENST00000572687
  CDS Start-End: 118-717
gatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgt

SEQ ID NO: 169191 - DNA, 842 bp, Homo sapiens
  Payload ID: 13303
  Gene Symbol: PAQR4
  Gene Name: progestin and adipoQ receptor family member IV
  ENST ID: ENST00000576565
  CDS Start-End: 139-759
tggctgcagagagactaccggccaccgccgccgccgccgccgcgagctgtccctgcggcgcgtctgccttggcggagccgaccgcagtgcgctcaggcgtccgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggc

SEQ ID NO: 169192 - DNA, 2452 bp, Homo sapiens
  Payload ID: 13304
  Gene Symbol: PAQR9
  Gene Name: progestin and adipoQ receptor family member IX
  Uniprot ID: Q6ZVX9
  ENST ID: ENST00000340634
  CDS Start-End: 347-1480
cgatgcccagtcaccgctgccgcgctgccgccgcagtcagccgcgccgccgccgctgccgcagcgcgggcggccgcgcgccggtagcaggggcttggcgaggaagccgctgagcctcgcgcgctccgcgctcctggcggtcgcagcgctgcctattaattgattctcttattgatttatttaatttttaggagcggctgctcggaggcacgggtcttctcctaaacctgcagcgacgcccccggcgtgggcacaaaggctccgacggcggccggcgggggctgcccagcgcccgggagccggcgccagaggtcgcctgcgcgcgccctagccgagccccgggcaccatgccgcggcgcctgcagccccggggcgcgggcacaaaaggccctccggccccggccccggcagcttcgggggccgcccggaactcccactctgccgcctcccgggaccccccagcgtctgccaagccgctgctgcgctgggacgaggtgcccgacgacttcgtggagtgcttcatcctgtcgggctaccggcgtctgccgtgcacggcccaggagtgcctagcctcggtgctgaagcctaccaacgagacgctcaacttctggacgcacttcatcccgctgctgctgttcctgagcaagttctgccgtctgttcttcctgagcggcggcgacgtgcccttccaccacccgtggctgctaccgttgtggtgctacgcgtcgggagtgctgctgaccttcgccatgagctgcacggcgcacgtgttcagctgcctgtcgctgcgtctgcgcgccgccttcttctacctggactacgcgtccatcagctactacggcttcggcagcacggtggcctactactactacctgttgccaggcctcagcttgctggatgccagagtcatgactccatacttgcagcagcgcctgggctggcacgtggactgcacgcgccttatcgccgcctaccgcgccctggtgctgcctgtggccttcgtgctggcggtggcttgcactgtggcctgctgcaagagccgtaccgactggtgtacctacccgttcgcgctgcgcaccttcgtcttcgtcatgccgctcagcatggcctgccccattatgctcgagagctggctcttcgacctgcgtggggagaaccccacactcttcgtgcacttctaccgccgctacttctggctggtggtggccgccttcttcaacgtgagcaagatccccgagcgcatccagccgggtcttttcgacattatcggccacagccaccagctcttccacatcttcaccttcctcagcatctacgaccaggtgtactacgtagaagagggcctgcgccagttcctccaggcgccgcctgccgcacccactttctcgggtactgtgggctacatgctgctgctggtggtctgcctggggctggtaatcaggaagttcctaaacagctccgaattctgcagtaaaaagtgagcctccgccttggaggagactactggttcgcccatctgtttggagtttctgttgttgctattgttggtttgttttcaaatttcattgtgttttcttctttgctcaaggaaggtgctgcaaaaccatagggaaaaagttcactgctacaaagggatcccaacccactggaggctttgaagtagggaggttggcaggggtggtcaagcgggagggagatagtcacttgttcttgcccctggaaaaaattcaggtgatgtctttgacatccagggatttctcaaaggcagtgagtaaaatcccaaataaagccccaaagagtttgcttttccaatcatctgtgccattggtaataaggagtagcccctgtgaggtcaggtacacagtaaagagggtaaatagaatccttgggaacttctgtttcagtctgaggaatgcttggatttgtcaaaagaatggagctttgtaggaaacaggcacaaagacgcaaacccagggcttaacctgctagaaaatgcatggaatgtgaacacaagttaattatttcaaaatgtttttcagatgttatttaaatagtaatatatacattgatttttcataatttatcaaagcctgtggtacgcactgaattttctttgtcacatagttttgaatttcacagccttctgcattgcatacacttgaactggacatcaggggaagctgcttgagagttctcaattactttcttaaacagtgttttctgaaggcgtgtgtcatgatacaactgtgaattctaccttagggactctggttaaactattggtgaggagctcgagtggtttgtatagaccccagatttttgtttactttaatgtattccacaaaacccatcctggtttttgttagtttgttttgtttttaatctttttttttccttctctacttatttaaattgccactggaataaatgtgccttttgaagcaaagtccaaa

SEQ ID NO: 169193 - DNA, 1824 bp, Homo sapiens
  Payload ID: 13304
  Gene Symbol: PAQR9
  Gene Name: progestin and adipoQ receptor family member IX
  ENST ID: ENST00000492509
  CDS Start-End: 1-439
gagctggctcttcgacctgcgtggggagaaccccacactcttcgtgcacttctaccgccgctacttctggctggtggtggccgccttcttcaacgtgagcaagatccccgagcgcatccagccgggtcttttcgacattatcggccacagccaccagctcttccacatcttcaccttcctcagcatctacgaccaggtgtactacgtagaagagggcctgcgccagttcctccaggcgccgcctgccgcacccactttctcgggtactgtgggctacatgctgctgctggtggtctgcctggggctggtaatcaggaagttcctaaacagctccgaattctgcagtaaaaagttctgccaaggggacaaatcacggaagattggattggaacaaaaagcagcagaaggcagctcatcagaaggttcccatttcctgtaatgaaagaatattgactgaggacttaagagtttccagtatgggatgtaaggagcttagaagttgtcactccatcttaacaagtaaaaagctgaactgaaaaatcaacaactcttcttgggtccatcagagacatgaagtcacagagcaaactgctgccccccaaaattggagagacataacaggtagacacagagaatcacaatttaacagagcaggaacccacaagaagaaatttctgcaagaaccagtaccaagttcttttgttccctgtacatcatgactagtttccaacaaaaaattacaaggcttaccaaaagacaaaaaacacagtttgaagaaacagagcaagcatgagaacaggctcagatatgacagggatgttggaattatcaggttgggaatttaaaataattatgctaaaggttctaatggaaaaataaacaatatgcaagaaccaacagataacgtacaaagagatgaaagttctgagaaaaaaatcaagcataaatgctagaaatcaagaacattgtgacatgaagaatgctttgatgggctcattactaggctagaccctgctgagtaaagaatcagcttgaggctatgtcactagaaacttctaaaactgaaaaacaaagaaaaaaagactagaaaaaaatcagaagagaatattcaagaaccgtggggcaattacaaaaggtgtaacctacacttaatgggaatacaaaaagaagaaagggagaggggaacagaaggatcaaataaacacccactcaaactctgcagcttgaaaggaaatgatattccacatagagacaagacttttgaattactttctctcttccctttctcagaagtccactatcagtttctgacctccaaaaacttttttcttaagagctgaaaaaattcctaaaagaaatggaagatggaagatttaaggaaactgattaactttgcaatttataaataaattttaagccataggattaataagaggtttcacatcctgcctgctcccataatgtccattctctctatcttgatactttgcagttgtaaaaatatatgtggaaaactgaaaggtgggcagaagtgaacatttattagtacaaaatgtaattctctaagagctactttactacttcaggatgacctgagtgaagctaatggcctagtttttactccagctcttattaattcagtgattgactgcattagttcatccctacctcactgtctatctgttttgagggtaggatctataaatatcagtttagagttctctcagattcttactttagttacacagaaatgtcataaagtacaaaaggaaacaggtttaaggaaataaataattctacagatacaggtaataagccaactat

SEQ ID NO: 169194 - DNA, 348 bp, Homo sapiens
  Payload ID: 13304
  Gene Symbol: PAQR9
  Gene Name: progestin and adipoQ receptor family member IX
  ENST ID: ENST00000498470
  CDS Start-End: 1-117
gtaatcaggaagttcctaaacagctccgaattctgcagtaaaaagttctgccaaggggacaaatcacggaagattggattggaacaaaaagcagcagaaggcagtctcctctgctgactttcatgcctgacatcaattttctcaaagagtgaagatagagcatctataccggtatagctgaaggactttggtcagtggcttcctggttctgccactttctgtcagctttcctgctcaatttagagacattctaattcttgttcagaaaaccttgagtccactcctgtaattcttctagtgagtttgtaagccaaccaatgcctactaataaatcccctttagcaccaa

SEQ ID NO: 169195 - DNA, 4943 bp, Homo sapiens
  Payload ID: 13305
  Gene Symbol: PAQR5
  Gene Name: progestin and adipoQ receptor family member V
  Uniprot ID: Q9NXK6
  ENST ID: ENST00000340965
  CDS Start-End: 132-1124
tgctgtcctctttcagggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaaatccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcatggcctaaaatattcataatggttggtgtcttttgaatgaattcatgtcaaaaatgttattcagctggggaaatttctctaaatgtacactgattctgtgtgtgtgattttaaaaggagaatatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcggggtgtcatgtgttctgttatgttctgttttctggttgccagtttgatctgcaaagtatttttcagtgcaggtaaaatgtgttaaaccataagagttgactgagttaatcccaattggttgtgctcatatgccaccttttaaaccaatggaaattgctatatttggggatgtcatacatttgatattgcttcagcatttcaaatatgttgcaaaatttagtatccatatgcataagaagttaatcaccttgccagtggggtggtcacatatagtgttctcaagctttactgtgaatcagaaacatccagtaagcttgtgacaaatgcagactcctagggaaaaccagggggttctgcttcactaggttaaatgtaggttttgtagaggagatctgcactggagcaagtctcccagatgattctaatacaggagggccagaggccaaacttgaagaactgctggtgttacatgttccaaaaggcattagacctatcagctttgtttcgcctgatctcaagttttagcaactcaccaactaaggcgtaacctcattttatgttccagcgttttctactctgaatagttctaaaacactgagcattttctcatttgttgcattactgattaaagttcagtatttcatggtgttttcagggaacacagaaatgcggatgcaaaacaacttttgacagaggcccatcaaacccagatctgcacttggtaatgacttaggggggcttcctcacaatgcaggatcctctttgctgactcaggaatactccatattttagactactgcctctaccattaactagcccagacatttgaatggccttgtaaacagctcactgtctaatactcgaaggacaagtaacaatttatattggatgagagtggtcaagaaatatgatttcgttagttttattatctgtttacttcctctggggaaggcagactgataaaattatatgggctggtaaatttttggtacattaattgcaagctgcatgacaaaatttgtttttctggcaacaatctgacattattagtggaattccacaccaacagggcttgtgagcttccatttcatcttactgtaacttcaattttatggcaaaaaaaggtacaaagtttaaatacccctttctagtaatgccaaagacatacagtgttttacattctctcctttataggtaacaaaataatgtttagctcagtaagtactgaaataatgagtgaccaatttgaaggatttttagattatttaatctttgcttatgttgctttttcacatgcttaatgatggaaatgaaatgttaaatcaacaaaataagatccagtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacatttaagacatgtgacacattcccattggtaacaattgctcaccatggcattgtctcaaaaaagactatggtggggagggtggcacattcctaatgggatgtacctctccccactccccttgcttgagaagcactactcaaaaatttaccagaccttacaactgtgataaaacttgaatgtgtatgatgaataaggccattcagttaactttacctccctttacccattgaaggggttccttttccattgctcagtttttagaaaataattctcatcttttttctaaagaaatgaatttgtggctggtctgaaggtagtgagttagctcaattgattgttcgcagtcagttatagatcaagctccttgttctactcttcccctcttctcactactgcacttgactagtcttaaaacaaagaaagaacgaatgaatgaatgaatctgtggctggatgcagtggctcatgcctgtaatcccagcactttgggaggctgaagtgggaggactgcttgggcccaagaattcaggaccagtctgggcaacagagccagacactgtctctataaaaaaaagttaaaactagctggttgtggtggtgcacacctgtggtcccagctactgtggagggtgatgtgggaggattgcttgaacccaggagttggatgctgcagtgagctatgattgcgccattgcgctccagactgggcaacagggcaagaccctgcctcaaaaaaaaaaaaaaaagaatttgtaattgttggtaggatgttatgggaaatttagaggtcttctgagtataaagtggtttaaatatttggtctgctgaagtctttctggaagtgttgttccccctgctgccccgcccagtagaaacttgctcatatgagaggttctgaggtaggtgcggtgtagtagaatggcattgtcagatatgttcaagaaacccttcatttgacactattttgtaccttatggtaccctttaacattttttaattaaaaaaaatattttttgagacagggtcttgttctgttgcccaggctggagtgtagtgttgcaatcttggctcactgcaacctctgcctgacaggcttcagtgatctttccacctcagcctcctgagtagctgggactacaggtgcatgccaccaagcctggctaactttttgtagagatagggttttgccatgctgcccaggctggcttagaattcctgaattcaagtgatttgtctgcctcaggctcccaaagtgctgggattacaggcatgagccacactgcacccagtccatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcata

SEQ ID NO: 169196 - DNA, 5337 bp, Homo sapiens
  Payload ID: 13305
  Gene Symbol: PAQR5
  Gene Name: progestin and adipoQ receptor family member V
  Uniprot ID: Q9NXK6
  ENST ID: ENST00000395407
  CDS Start-End: 387-1379
gggcccgcgagtccggggtcgccgcagcccgggaggagtgtctggtctccggcctgcctgtgctgtccccgcgccctgtccactggactcccgagacccttggaacccaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtgggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaaatccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcatggcctaaaatattcataatggttggtgtcttttgaatgaattcatgtcaaaaatgttattcagctggggaaatttctctaaatgtacactgattctgtgtgtgtgattttaaaaggagaatatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcggggtgtcatgtgttctgttatgttctgttttctggttgccagtttgatctgcaaagtatttttcagtgcaggtaaaatgtgttaaaccataagagttgactgagttaatcccaattggttgtgctcatatgccaccttttaaaccaatggaaattgctatatttggggatgtcatacatttgatattgcttcagcatttcaaatatgttgcaaaatttagtatccatatgcataagaagttaatcaccttgccagtggggtggtcacatatagtgttctcaagctttactgtgaatcagaaacatccagtaagcttgtgacaaatgcagactcctagggaaaaccagggggttctgcttcactaggttaaatgtaggttttgtagaggagatctgcactggagcaagtctcccagatgattctaatacaggagggccagaggccaaacttgaagaactgctggtgttacatgttccaaaaggcattagacctatcagctttgtttcgcctgatctcaagttttagcaactcaccaactaaggcgtaacctcattttatgttccagcgttttctactctgaatagttctaaaacactgagcattttctcatttgttgcattactgattaaagttcagtatttcatggtgttttcagggaacacagaaatgcggatgcaaaacaacttttgacagaggcccatcaaacccagatctgcacttggtaatgacttaggggggcttcctcacaatgcaggatcctctttgctgactcaggaatactccatattttagactactgcctctaccattaactagcccagacatttgaatggccttgtaaacagctcactgtctaatactcgaaggacaagtaacaatttatattggatgagagtggtcaagaaatatgatttcgttagttttattatctgtttacttcctctggggaaggcagactgataaaattatatgggctggtaaatttttggtacattaattgcaagctgcatgacaaaatttgtttttctggcaacaatctgacattattagtggaattccacaccaacagggcttgtgagcttccatttcatcttactgtaacttcaattttatggcaaaaaaaggtacaaagtttaaatacccctttctagtaatgccaaagacatacagtgttttacattctctcctttataggtaacaaaataatgtttagctcagtaagtactgaaataatgagtgaccaatttgaaggatttttagattatttaatctttgcttatgttgctttttcacatgcttaatgatggaaatgaaatgttaaatcaacaaaataagatccagtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacatttaagacatgtgacacattcccattggtaacaattgctcaccatggcattgtctcaaaaaagactatggtggggagggtggcacattcctaatgggatgtacctctccccactccccttgcttgagaagcactactcaaaaatttaccagaccttacaactgtgataaaacttgaatgtgtatgatgaataaggccattcagttaactttacctccctttacccattgaaggggttccttttccattgctcagtttttagaaaataattctcatcttttttctaaagaaatgaatttgtggctggtctgaaggtagtgagttagctcaattgattgttcgcagtcagttatagatcaagctccttgttctactcttcccctcttctcactactgcacttgactagtcttaaaacaaagaaagaacgaatgaatgaatgaatctgtggctggatgcagtggctcatgcctgtaatcccagcactttgggaggctgaagtgggaggactgcttgggcccaagaattcaggaccagtctgggcaacagagccagacactgtctctataaaaaaaagttaaaactagctggttgtggtggtgcacacctgtggtcccagctactgtggagggtgatgtgggaggattgcttgaacccaggagttggatgctgcagtgagctatgattgcgccattgcgctccagactgggcaacagggcaagaccctgcctcaaaaaaaaaaaaaaaagaatttgtaattgttggtaggatgttatgggaaatttagaggtcttctgagtataaagtggtttaaatatttggtctgctgaagtctttctggaagtgttgttccccctgctgccccgcccagtagaaacttgctcatatgagaggttctgaggtaggtgcggtgtagtagaatggcattgtcagatatgttcaagaaacccttcatttgacactattttgtaccttatggtaccctttaacattttttaattaaaaaaaatattttttgagacagggtcttgttctgttgcccaggctggagtgtagtgttgcaatcttggctcactgcaacctctgcctgacaggcttcagtgatctttccacctcagcctcctgagtagctgggactacaggtgcatgccaccaagcctggctaactttttgtagagatagggttttgccatgctgcccaggctggcttagaattcctgaattcaagtgatttgtctgcctcaggctcccaaagtgctgggattacaggcatgagccacactgcacccagtccatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcataaagtcatcctgtttgccacttaatttggttatgttttatctaccacactgcaaatatgttaattcaccatgagaaacagatccctgtacacatgtgtatcagtaaatcattcaatgaatagttagtgcttaggatgtat

SEQ ID NO: 169197 - DNA, 728 bp, Homo sapiens
  Payload ID: 13305
  Gene Symbol: PAQR5
  Gene Name: progestin and adipoQ receptor family member V
  ENST ID: ENST00000558684
  CDS Start-End: 348-728
cgcgagtccggggtcgccgcagcccgggaggagtgtctggtctccggcctgcctgtgctgtccccgcgccctgtccactggactcccgagacccttggaacccaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccagg

SEQ ID NO: 169198 - DNA, 2347 bp, Homo sapiens
  Payload ID: 13305
  Gene Symbol: PAQR5
  Gene Name: progestin and adipoQ receptor family member V
  Uniprot ID: Q9NXK6
  ENST ID: ENST00000561153
  CDS Start-End: 673-1665
agcttaacaagaccatggcctctggacccgcgatcagctcgctgtgtggtcctgagcagccacccaacatctctgggccttggattcctacctggcctttcttctggatgcatcatttttgcctttaggtatctggaccattcccccccatggatgataaagtctttgcttcacaccctcaggattaccttaaaggcctgaaaagaacagaggaggagtctgaggaggtgaattccagccgtgctcttgcaggctggctgggcagtgtgctggggaggagagggagcctctggctgggcctcctccaccgggcctggtgtgctgggaacaccccgcattgtcccaaggcctcagatttgactttcaaagggaaaacagctctcctgataaaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtggtaaggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaaatccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcatggcctaaaatattcataatggttggtgtcttttgaatgaattcatgtcaaaaatgttattcagctggggaaatttctctaaatgtacactgattctgtgtgtgtgattttaaaaggagaatatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcgggg

SEQ ID NO: 169199 - DNA, 1908 bp, Homo sapiens
  Payload ID: 13306
  Gene Symbol: PAQR6
  Gene Name: progestin and adipoQ receptor family member VI
  Uniprot ID: Q6TCH4
  ENST ID: ENST00000292291
  CDS Start-End: 160-1194
actccccgcccaggcctggcccgcctgcctggccactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagca

SEQ ID NO: 169200 - DNA, 2117 bp, Homo sapiens
  Payload ID: 13306
  Gene Symbol: PAQR6
  Gene Name: progestin and adipoQ receptor family member VI
  Uniprot ID: Q6TCH4
  ENST ID: ENST00000335852
  CDS Start-End: 617-1672
ttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggtgagggcacgcctggcccggcccgggaagaggcaggggcagatgccttcccagagcacagaatgaactgggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagc

SEQ ID NO: 169201 - DNA, 1799 bp, Homo sapiens
  Payload ID: 13306
  Gene Symbol: PAQR6
  Gene Name: progestin and adipoQ receptor family member VI
  ENST ID: ENST00000340183
  CDS Start-End: 1-1092
actcttcctccatcagcctggctggcagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctggtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttg

SEQ ID NO: 169202 - DNA, 2143 bp, Homo sapiens
  Payload ID: 13306
  Gene Symbol: PAQR6
  Gene Name: progestin and adipoQ receptor family member VI
  Uniprot ID: Q6TCH4
  ENST ID: ENST00000356983
  CDS Start-End: 310-1335
tgttccctggctcccctttgtctccccactccccgcccaggcctggcccgcctgcctggccactcttcctccatcagcctggctggcagcagccttggactccgcccgtggagccctgggcctgttgacccaccagcttaggagcacccaccaagctctggcagggtctccagcacccatctcgggcagaggctgggggagtgactgctggtgcaagccccaaagtgcatgcggcaaaaacatggatgcagagctggtggcaagaagaggggctaagttatagagtcaacgtggaggtaccaggccaccatgctcagtctcaagctgccccaacttcttcaagtccaccaggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagcactttctagaactgaagaaggtaaaacctcctcacccccatcctcctgacacctccctcccacactccataaactggacagactcacaggcccac

SEQ ID NO: 169203 - DNA, 1765 bp, Homo sapiens
  Payload ID: 13306
  Gene Symbol: PAQR6
  Gene Name: progestin and adipoQ receptor family member VI
  Uniprot ID: Q6TCH4
  ENST ID: ENST00000368270
  CDS Start-End: 97-1059
cagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaacttt

SEQ ID NO: 169204 - DNA, 1729 bp, Homo sapiens
  Payload ID: 13306
  Gene Symbol: PAQR6
  Gene Name: progestin and adipoQ receptor family member VI
  ENST ID: ENST00000540423
  CDS Start-End: 554-1189
tgttccctggctcccctttgtctccccactccccgcccaggcctggcccgcctgcctggccactcttcctccatcagcctggctggcagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagcactttctagaactgaagaaggtaaaacctcctcacccccatcctcctgacacctccctcccacactccataaactggacagactcacaggcccac

SEQ ID NO: 169205 - DNA, 1599 bp, Homo sapiens
  Payload ID: 13306
  Gene Symbol: PAQR6
  Gene Name: progestin and adipoQ receptor family member VI
  ENST ID: ENST00000613336
  CDS Start-End: 424-1059
tgttccctggctcccctttgtctccccactccccgcccaggcctggcccgcctgcctggccactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctgctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagcactttctagaactgaagaaggtaaaacctcctcacccccatcctcctgacacctccctcccacactccataaactggacagactcacaggcccac

SEQ ID NO: 169206 - DNA, 2037 bp, Homo sapiens
  Payload ID: 13306
  Gene Symbol: PAQR6
  Gene Name: progestin and adipoQ receptor family member VI
  ENST ID: ENST00000612424
  CDS Start-End: 646-1497
tgttccctggctcccctttgtctccccactccccgcccaggcctggcccgcctgcctggccactcttcctccatcagcctggctggcagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcgggctggcaccaggacgctttgattacatcggtgagggcacgcctggcccggcccgggaagaggcaggggcagatgccttcccagagcacagaatgaactgggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagcactttctagaactgaagaaggtaaaacctcctcacccccatcctcctgacacctccctcccacactccataaactggacagactcacaggcccac

SEQ ID NO: 169207 - DNA, 1961 bp, Homo sapiens
  Payload ID: 13306
  Gene Symbol: PAQR6
  Gene Name: progestin and adipoQ receptor family member VI
  ENST ID: ENST00000623241
  CDS Start-End: 786-1421
tgttccctggctcccctttgtctccccactccccgcccaggcctggcccgcctgcctggccactcttcctccatcagcctggctggcagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctggtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaacgttttctggaacaaggcaggtacaaataaaaaaataaaactttggaaagcactttctagaactgaagaaggtaaaacctcctcacccccatcctcctgacacctccctcccacactccataaactggacagactcacaggcccac

SEQ ID NO: 169208 - DNA, 3297 bp, Homo sapiens
  Payload ID: 13307
  Gene Symbol: PAQR7
  Gene Name: progestin and adipoQ receptor family member VII
  Uniprot ID: Q86WK9
  ENST ID: ENST00000374296
  CDS Start-End: 668-1708
tgaattcaaaacagttactctgaatggtctttgctaagaacaatttaatgattaagtaaggtcagtgtccttggaagtccaaactctagccagatttccctggtctacacccctagggataaggtaaatgtttaagcacacagtgaacttcctgaggcccccaaatctaatggaactagctattgagggctaaaagaggatggtttttttagaaaactcgaagcaaatctctcaggctggggatatttcaaagactactactattattattaataacaattgcaatatttgttgagtccctaaatgaagctaaaactttgttctaataaatttaatctttacagcaacctatgaggtagataatattgtcattcccatgagggagctaaggatcagagaaggtaagtcacttgtctaaggtcacatagctagcatgttatgcaatcaggagtcaaacctggtttgtctgaatctgaagtccatctgctctgtgcacttttataccgtctgctttttcctttattcctaaccttcttccattctgattcccactgagtagtggacaggaaccactgaagtttgcctgacaccatcaaccaggccctagtcacctggctttgcctttgccctgctgtgtgatcttagctccctgcccaggcccacagccatggccatggcccagaaactcagccacctcctgccgagtctgcggcaggtcatccaggagcctcagctatctctgcagccagagcctgtcttcacggtggatcgagctgaggtgccgccgctcttctggaagccgtacatctatgcgggctaccggccgctgcatcagacctggcgcttctatttccgcacgctgttccagcagcacaacgaggccgtgaatgtctggacccacctgctggcggccctggtactgctgctgcggctggccctctttgtggagaccgtggacttctggggagacccacacgccctgcccctcttcatcattgtccttgcctctttcacctacctctccttcagtgccttggctcacctcctgcaggccaagtctgagttctggcattacagcttcttcttcctggactatgtgggggtggccgtgtaccagtttggcagtgccttggcacacttctactatgctatcgagcccgcctggcatgcccaggtgcaggctgtttttctgcccatggctgcctttctcgcctggctttcctgcattggctcctgctataacaagtacatccagaaaccaggcctgctgggccgcacatgccaggaggtgccctccgtcctggcctacgcactggacattagtcctgtggtgcatcgtatcttcgtgtcctccgaccccaccacggatgatccagctcttctctaccacaagtgccaggtggtcttctttctgctggctgctgccttcttctctaccttcatgcccgagcgctggttccctggcagctgccatgtcttcgggcagggccaccaacttttccacatcttcttggtgctgtgcacgctggctcagctggaggctgtggcactggactatgaggcccgacggcccatctatgagcctctgcacacgcactggcctcacaacttttctggcctcttcctgctcacggtgggcagcagcatcctcactgcattcctcctgagccagctggtacagcgcaaacttgatcagaagaccaagtgaagggggatggcatctggtagggagggaggtatagttgggggacaggggtctgggtttggctccaggtgggaacaaggcctggtaaagttgtttgtgtctggcccacagtgactctctgtgcacgactcaactgccaagggcatcactggccaattcttggatttagggattggctaggagttgctggggtccactcctgggcctgccccagctccttgcccagggagagggaaagagttaacggtgtgggccactccagcttgcccttccactgccactcactggggtgaggctgggggtcagcttggtgaggattggggcttctagattgtctaggcaggaggtgaaacttaggccagagtcagatttgagctgagccaggggaggccttggcaacctacttctactcagatttcattgctggatgcggaaggggtaggcccaaaatatatacaggatcttactgtcccttgaagcccagccacaagtgttggagctgcagagagaccccaaaggtagtagattgtgccagatacaaatgggtcccatccagtgcttcatactccttcagtcactatcccagacagtgagccccagatctcctagctctggcttctgtgtcccacacggcctgttcccagcttctctcctggttcccttgttacggattcatttatccattcagtgtttcctgggcctctgctcagaggcaggtcaccactgggccctgtggatcaatgcaagatgacaaaggctttttttttttttttttttttttttttttttgaggagtttcgctcttgttggctaggctggagtaaaatggtgcgatctcggctcactgcacctccgcctcccaggttcaagcgattttcctgcctcagcctcccgagtagctggggttacaggcatgcaccaccatgcctggctaattttctgtatttttagtagagacggggtttctccatgttggtcaggctggtcttgaactcctgacctcaggtgatctgcccgtctcggcctcccaaagtgctgggattaccggcatgagccactgcgcctggccgacaaaggctttgatatcagaatgaactgtcaagggaggtgctggagagggattaacctgtgctgcctgggaccctcagggtcttaggttggggagtgtgaataggagtttgcagatggagaataggaagggcattccaggcagagggaaacctgtgcagagaccaagaggtgtggaaggaaaagtggggttggggctgggtggtctggattatggcctggatgcaataaagtactgtgacagtagccacctctttgttttttgtctcctgtttccgggaggggcccctgctcacattactggaggttttccggaggaagctggggcccctgggagtggacacagggtgcagggagcagttcttgttttatctttgctgggggatggggttggggccttatataccatatctatatatacaaaatttgtttggcaagggagtgggcggcagttttattactaaagttttataagtagttaaaataatgtgtttaaaatatgataatcccactttatgatctga

SEQ ID NO: 169209 - DNA, 4655 bp, Homo sapiens
  Payload ID: 13308
  Gene Symbol: PAQR8
  Gene Name: progestin and adipoQ receptor family member VIII
  Uniprot ID: Q8TEZ7
  ENST ID: ENST00000360726
  CDS Start-End: 178-1242
cccgatgttgagtctccgaatccaagcccggaaggggggacgacggggtctcttgcctgctgtgtactgcttttactgccagaaatgttctcctcacctgggagccagttggctgccaacactgagttgcataccctgtcctgagggcgcggcacggagtgcatgcgggccgctgccatgacgaccgccatcttggagcgcctgagcaccctgtcggtcagcgggcagcagctgcgccgcctgcccaagatcctggaggatgggcttcccaagatgccttgcactgtcccagaaacggatgtgccccagctcttccgggagccttacatccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctgctcctcttcatcctgtcgtcaatcacttacctcacctgcagccttctggcccacctgctgcagtccaagtcagagctctcccactacaccttctactttgtggactatgttggcgtgagcgtttaccaatatggcagtgctttggctcatttcttctacagctctgaccaggcctggtatgaccggttctggcttttcttcttgccagcagctgccttctgtggctggttatcttgtgctggctgttgctatgccaaatatcgttaccggaggccttatccagtcatgaggaagatctgtcaagtggtgccagcaggtctggcttttatcctagacatcagccctgtggcacaccgtgtggcgctctgtcacctggctggctgccaggagcaagcagcctggtaccacaccctccagatcctcttcttcctggttagcgcttatttcttctcctgccccgtgcctgagaagtacttcccgggttcctgtgacatcgtgggccatgggcatcagatcttccatgcatttctgtccatctgtacgctctcccagctggaggccatcctcctggactaccaggggcggcaggagatcttcctgcagcgccatggacccctatctgtccacatggcctgcctctccttcttcttcctggctgcctgcagtgctgccaccgcagcccttctgaggcacaaagtcaaggccagactgaccaagaaagattcctgaggctggcaagtggggcaacgtgtggaggaagcccctcataatttggagaaaacttgatacaatagaagctgacttttaaggcattggcttttaaattaatacatatatccaaggatatgttatagctgcagtgtttgaaagccaaaggatttaagagttttgttgttgttaataaaaggaatactccttttccttttggatcatagcttaacaaggcacaggaagggaagggatcttgactaagattcatgagacattgaattaaggagaatcatcttcatgcctgaaaatttagcaaaattccgactatggcctccaggggcaattcctaaaagctgaatggataataaaattggactggaaagtaagtaggtggctggtcctcaccctgttggaatggctatcctactatgctgttctttggtaatggaataaattgacccaaggaccgaatttcatttggatttcaaattgtccagagtggaaaagccttcaagatgacatgatgaattactcagttcatctgatttctggtccctcctttctcgacaactataatactaacccttttctcaggataactgtctacacctggcagttttctctgacgtgctgttcactcacatccctaccttgcatggtaatataaaggactaggaagcagtcatacttccaggaaatgcttggattcatgtggacattcaggaagcttattctcatataatactaatctaaacagtactagaaattacagtgccaagagccaccaggaggcccagccaataagcatagatactatatggtatcatgggacccatctattttttaccagtggactacaggattacttgagagttatcagggctgcctaacagaccaggagatctgggggttgcaccagggaatcgccatatttgaccagcatgttttaaaagctcttggtaggattagttggttctaaggatccctctagggacctcattatttcaagaggaacccaaagtccagcctcctacatagatgctgccccacgaaggacccacaaaactaacctagttcagggttctcaggcaggcagttctgcttcagcttagagcagaacccataaaatactcaagtactgggataggcaagcatgtgtgtttactgtggattggtccctgaaggctcctttgggtgagaacatgtgaaccaggcaccctggtttgtttggagcattgctgcccagaagcttctatgggataggtggtgcttgggattgatgtgttgtggccatgcagccctccctgaggattgacttctgcactaatccagtgaaggaggctgtgtcaaaagaagggctcagaagccctcttttcagaggcaatgattcctgtcagtatgaggtcccttagttactaaaaagggacatgatttaactccagtttgatgaacctcctccgagtttactttattgtcttcaaatcttttgttttcttcctttttgtgagatttgtgggttttgtgccttataaatggaaatgtatgaacacaatatatgctcatgtagaattttctgttctgggttattgggataagaaaaaatatatattgctcttcaactagtgaatgaaagaaacttcagaaagctagaattgcttatcaatcaaaagactttctcaatctattttggccacaaacaaacatattcaactgaagctttccaataatctttatatcaagaaagcatgcgtcttgtcagctacattgttttcttagatggatttctcctgttaatcctcaaatatctgaacttctgtgttacccaagtgtcttatacaagcttctggtgtctaggacaaatttatggcaaataaaattagcaaaactgaactgggttgaactgaacaagaggatgggggaattgtgcaaatacgttgttagtagaaggtcaatttaaaatagggactagaaattatttgaagttttctttattacggattcaaagacttattttgaaagttggaaggagaagggagggaagagagcagaagggaagaaggtgtaagtcaagctcttgaatataactggtggtattgtgggcagagatctttagttcaaatccacgtattttttaaaagagagaaccggaggtagagcaatgatcagatgggtgcacagaccagtgccaatctgaacattgttaatggcctgtgacatgatgagcacaggaacaggcatgaagatattgccatacaattttaatttatacaagtattggcccctcaagtggttggaaattttttttttaatctctttttctgagacagggtcttactctgtcgcccaggctggagtgcagtgatgcaatcacggctcactgcagcctcgacctccccagctcaagcaatcctcccacctcagcctcctaagtacctggtactacaggcgcgtgccaccacacctggctaatttttgcattttttgtagagacagggttttgccacgttgcttaggctggtcttgaactcctgaactcaagtgatccgcccacctcagcctcccaaagtgttgggattacagacattagccatcacgcctgccctagaaacagttttttaataggagatatttgagaggcattgaggtaggagactctatgacatgccctcagaatatcagaatcttcttagaaataaactaggaaatgcagatgtttttaactactcagacttttgaggaattaatccttttaaaacatttttgttaaagttagtgtatcagtaagaaacagacctagtttaaaaggaataatcaacaattttataaaggagatggcttattcaaccatagcccctccaacatatctactggaaattctgctggttaactttatctctctctctcttaatttagactttcaacctatgaaaatgtaaatacctttgaaaaaactaaactatcagtcatttacatcctctcatgaatgaaatgcagtgtagggagaggagatggcaggacacagcaaacaggacacatttgcctgcttctctcttgcctaattcttcctgacctgtatttactgatgcttaataatacttgtaagactctaggggttcatttcccatttcagcggaaagtacttcactcaacaacaatattctcaagagtcttctactggaagctagaaagaaataggaatttaagtccatagaatgaaggtagttattcctgcctgtgttgcccacctgttcacaaaaagtacctttatgcttgaaaacattaggttctttggttactgcactgtagtttcaaatggatcctccagatggcattcatgtcttactcagaaagggcactgccattgtccccaaggcttctgtctactaattctattggtcttgtgttttgcttgcttggcaaaaaaaaaaaaa

SEQ ID NO: 169210 - DNA, 4738 bp, Homo sapiens
  Payload ID: 13308
  Gene Symbol: PAQR8
  Gene Name: progestin and adipoQ receptor family member VIII
  Uniprot ID: Q8TEZ7
  ENST ID: ENST00000442253
  CDS Start-End: 175-1239
cccgagccgagcccgccgcggtcacagccacccgcgggaagctcgtggccgggaccccgaggcgggagcgcgggctgggccgggctgggctacgcgcacgggctcggccgccgcccctgccggttgcataccctgtcctgagggcgcggcacggagtgcatgcgggccgctgccatgacgaccgccatcttggagcgcctgagcaccctgtcggtcagcgggcagcagctgcgccgcctgcccaagatcctggaggatgggcttcccaagatgccttgcactgtcccagaaacggatgtgccccagctcttccgggagccttacatccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctgctcctcttcatcctgtcgtcaatcacttacctcacctgcagccttctggcccacctgctgcagtccaagtcagagctctcccactacaccttctactttgtggactatgttggcgtgagcgtttaccaatatggcagtgctttggctcatttcttctacagctctgaccaggcctggtatgaccggttctggcttttcttcttgccagcagctgccttctgtggctggttatcttgtgctggctgttgctatgccaaatatcgttaccggaggccttatccagtcatgaggaagatctgtcaagtggtgccagcaggtctggcttttatcctagacatcagccctgtggcacaccgtgtggcgctctgtcacctggctggctgccaggagcaagcagcctggtaccacaccctccagatcctcttcttcctggttagcgcttatttcttctcctgccccgtgcctgagaagtacttcccgggttcctgtgacatcgtgggccatgggcatcagatcttccatgcatttctgtccatctgtacgctctcccagctggaggccatcctcctggactaccaggggcggcaggagatcttcctgcagcgccatggacccctatctgtccacatggcctgcctctccttcttcttcctggctgcctgcagtgctgccaccgcagcccttctgaggcacaaagtcaaggccagactgaccaagaaagattcctgaggctggcaagtggggcaacgtgtggaggaagcccctcataatttggagaaaacttgatacaatagaagctgacttttaaggcattggcttttaaattaatacatatatccaaggatatgttatagctgcagtgtttgaaagccaaaggatttaagagttttgttgttgttaataaaaggaatactccttttccttttggatcatagcttaacaaggcacaggaagggaagggatcttgactaagattcatgagacattgaattaaggagaatcatcttcatgcctgaaaatttagcaaaattccgactatggcctccaggggcaattcctaaaagctgaatggataataaaattggactggaaagtaagtaggtggctggtcctcaccctgttggaatggctatcctactatgctgttctttggtaatggaataaattgacccaaggaccgaatttcatttggatttcaaattgtccagagtggaaaagccttcaagatgacatgatgaattactcagttcatctgatttctggtccctcctttctcgacaactataatactaacccttttctcaggataactgtctacacctggcagttttctctgacgtgctgttcactcacatccctaccttgcatggtaatataaaggactaggaagcagtcatacttccaggaaatgcttggattcatgtggacattcaggaagcttattctcatataatactaatctaaacagtactagaaattacagtgccaagagccaccaggaggcccagccaataagcatagatactatatggtatcatgggacccatctattttttaccagtggactacaggattacttgagagttatcagggctgcctaacagaccaggagatctgggggttgcaccagggaatcgccatatttgaccagcatgttttaaaagctcttggtaggattagttggttctaaggatccctctagggacctcattatttcaagaggaacccaaagtccagcctcctacatagatgctgccccacgaaggacccacaaaactaacctagttcagggttctcaggcaggcagttctgcttcagcttagagcagaacccataaaatactcaagtactgggataggcaagcatgtgtgtttactgtggattggtccctgaaggctcctttgggtgagaacatgtgaaccaggcaccctggtttgtttggagcattgctgcccagaagcttctatgggataggtggtgcttgggattgatgtgttgtggccatgcagccctccctgaggattgacttctgcactaatccagtgaaggaggctgtgtcaaaagaagggctcagaagccctcttttcagaggcaatgattcctgtcagtatgaggtcccttagttactaaaaagggacatgatttaactccagtttgatgaacctcctccgagtttactttattgtcttcaaatcttttgttttcttcctttttgtgagatttgtgggttttgtgccttataaatggaaatgtatgaacacaatatatgctcatgtagaattttctgttctgggttattgggataagaaaaaatatatattgctcttcaactagtgaatgaaagaaacttcagaaagctagaattgcttatcaatcaaaagactttctcaatctattttggccacaaacaaacatattcaactgaagctttccaataatctttatatcaagaaagcatgcgtcttgtcagctacattgttttcttagatggatttctcctgttaatcctcaaatatctgaacttctgtgttacccaagtgtcttatacaagcttctggtgtctaggacaaatttatggcaaataaaattagcaaaactgaactgggttgaactgaacaagaggatgggggaattgtgcaaatacgttgttagtagaaggtcaatttaaaatagggactagaaattatttgaagttttctttattacggattcaaagacttattttgaaagttggaaggagaagggagggaagagagcagaagggaagaaggtgtaagtcaagctcttgaatataactggtggtattgtgggcagagatctttagttcaaatccacgtattttttaaaagagagaaccggaggtagagcaatgatcagatgggtgcacagaccagtgccaatctgaacattgttaatggcctgtgacatgatgagcacaggaacaggcatgaagatattgccatacaattttaatttatacaagtattggcccctcaagtggttggaaattttttttttaatctctttttctgagacagggtcttactctgtcgcccaggctggagtgcagtgatgcaatcacggctcactgcagcctcgacctccccagctcaagcaatcctcccacctcagcctcctaagtacctggtactacaggcgcgtgccaccacacctggctaatttttgcattttttgtagagacagggttttgccacgttgcttaggctggtcttgaactcctgaactcaagtgatccgcccacctcagcctcccaaagtgttgggattacagacattagccatcacgcctgccctagaaacagttttttaataggagatatttgagaggcattgaggtaggagactctatgacatgccctcagaatatcagaatcttcttagaaataaactaggaaatgcagatgtttttaactactcagacttttgaggaattaatccttttaaaacatttttgttaaagttagtgtatcagtaagaaacagacctagtttaaaaggaataatcaacaattttataaaggagatggcttattcaaccatagcccctccaacatatctactggaaattctgctggttaactttatctctctctctcttaatttagactttcaacctatgaaaatgtaaatacctttgaaaaaactaaactatcagtcatttacatcctctcatgaatgaaatgcagtgtagggagaggagatggcaggacacagcaaacaggacacatttgcctgcttctctcttgcctaattcttcctgacctgtatttactgatgcttaataatacttgtaagactctaggggttcatttcccatttcagcggaaagtacttcactcaacaacaatattctcaagagtcttctactggaagctagaaagaaataggaatttaagtccatagaatgaaggtagttattcctgcctgtgttgcccacctgttcacaaaaagtacctttatgcttgaaaacattaggttctttggttactgcactgtagtttcaaatggatcctccagatggcattcatgtcttactcagaaagggcactgccattgtccccaaggcttctgtctactaattctattggtcttgtgttttgcttgcttggcaaaaaaaaaaaaaaaaaaaaaaaaaaaaaaaatggagctattttctgtctatataaatctacttatatgaataaccattaaagtgattttgtatatgca

SEQ ID NO: 169211 - DNA, 582 bp, Homo sapiens
  Payload ID: 13308
  Gene Symbol: PAQR8
  Gene Name: progestin and adipoQ receptor family member VIII
  ENST ID: ENST00000512121
  CDS Start-End: 247-582
aattgatcatccaacttcttaactgtctttttctcatggtaaaataccgagaacattgtgggtgaggagcaagtcgggaggtggaacccacccccgcaccctgcctccaatagattgtatgtgtgggtcgctattgctgggacccacgaaggctgtggattgaggacacagggtagaagtgggatcttctgcaggttgcataccctgtcctgagggcgcggcacggagtgcatgcgggccgctgccatgacgaccgccatcttggagcgcctgagcaccctgtcggtcagcgggcagcagctgcgccgcctgcccaagatcctggaggatgggcttcccaagatgccttgcactgtcccagaaacggatgtgccccagctcttccgggagccttacatccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctg

SEQ ID NO: 169212 - DNA, 2114 bp, Homo sapiens
  Payload ID: 13309
  Gene Symbol: PDCD1
  Gene Name: programmed cell death 1
  Uniprot ID: Q15116
  ENST ID: ENST00000334409
  CDS Start-End: 71-937
acagtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaagga

SEQ ID NO: 169213 - DNA, 366 bp, Homo sapiens
  Payload ID: 13309
  Gene Symbol: PDCD1
  Gene Name: programmed cell death 1
  ENST ID: ENST00000343705
  CDS Start-End: 1-366
caacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagggacaataggagccaggcgcaccggccagcccctgaaggaggacccctcagccgtgcctgtgttctctgtggactatggggagctggatttccagtggcg

SEQ ID NO: 169214 - DNA, 1019 bp, Homo sapiens
  Payload ID: 13309
  Gene Symbol: PDCD1
  Gene Name: programmed cell death 1
  ENST ID: ENST00000418831
  CDS Start-End: 28-228
cggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactgagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtg

SEQ ID NO: 169215 - DNA, 2114 bp, Homo sapiens; identical to SEQ ID NO: 169212
  Payload ID: 13309
  Gene Symbol: PDCD1
  Gene Name: programmed cell death 1
  Uniprot ID: Q15116
  ENST ID: ENST00000618185
  CDS Start-End: 71-937

SEQ ID NO: 169216 - DNA, 1019 bp, Homo sapiens; identical to SEQ ID NO: 169214
  Payload ID: 13309
  Gene Symbol: PDCD1
  Gene Name: programmed cell death 1
  ENST ID: ENST00000630560
  CDS Start-End: 28-228

SEQ ID NO: 169217 - DNA, 366 bp, Homo sapiens; identical to SEQ ID NO: 169213
  Payload ID: 13309
  Gene Symbol: PDCD1
  Gene Name: programmed cell death 1
  ENST ID: ENST00000630230
  CDS Start-End: 1-366

SEQ ID NO: 169218 - DNA, 2365 bp, Homo sapiens
  Payload ID: 13310
  Gene Symbol: PDCD1LG2
  Gene Name: programmed cell death 1 ligand 2
  Uniprot ID: Q9BQ51
  ENST ID: ENST00000397747
  CDS Start-End: 249-1070
ttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatccccttctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaa

SEQ ID NO: 169219 - DNA, 2067 bp, Homo sapiens
  Payload ID: 13311
  Gene Symbol: PDCD10
  Gene Name: programmed cell death 10
  Uniprot ID: Q9BUL8
  ENST ID: ENST00000392750
  CDS Start-End: 419-1057
aagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcggaagaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaatgcatatatatatgtgtgtatatatatatatatatatatatatatgaacagaagaccaagacaacttggtgtaatgtctaaaaaacttctaatgggagcttatcagcagtttatcaaataataaagcaagaatttctatttttgtccttaatcactttggacacagagtagtcaatggaaatatttttgttaattacttataaggtactgagtatttttatatgatttccaacctgttttaaacgacttatgagtaagagatagcattttctagtgtttttgcactataatgccactttttgaactcttgtgacaaatgtagatttgactcttaaaaattaagcctttcgtatactgggccctcataagctttgcacaattttttcccaaaaaatagccacaattaatagtaatttgaagctatatcaacggttggattgaaattgtcatgagtgttaatattatatacactcttcaactaggtacagttttatttcaccatagagaagttttaaggaaattatgtatcaagtgttcatgttaagtggtttcatttttcaattataaaataaagggaaaaaatcagaa

SEQ ID NO: 169220 - DNA, 849 bp, Homo sapiens
  Payload ID: 13311
  Gene Symbol: PDCD10
  Gene Name: programmed cell death 10
  ENST ID: ENST00000475915
  CDS Start-End: 242-849
ggcggatgtgcctggggtggggtcctttgaaggtgtggcttcggaccgagagctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaactt

SEQ ID NO: 169221 - DNA, 1026 bp, Homo sapiens
  Payload ID: 13311
  Gene Symbol: PDCD10
  Gene Name: programmed cell death 10
  Uniprot ID: Q9BUL8
  ENST ID: ENST00000470131
  CDS Start-End: 336-974
gggtccttccggcgtcgccggagtgaattgatccgggagttgaagagggctgcaaggtgggaagtgaagtcagtgcctcagttgctgaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctt

SEQ ID NO: 169222 - DNA, 814 bp, Homo sapiens
  Payload ID: 13311
  Gene Symbol: PDCD10
  Gene Name: programmed cell death 10
  ENST ID: ENST00000492396
  CDS Start-End: 171-620
ctagctttctcctctaaatcttggtctcttgtttggaagtgactaacagcattttggcatgagaaagccctaaaaagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagatt

SEQ ID NO: 169223 - DNA, 764 bp, Homo sapiens
  Payload ID: 13311
  Gene Symbol: PDCD10
  Gene Name: programmed cell death 10
  ENST ID: ENST00000471885
  CDS Start-End: 196-756
gaagagggctgcaaggtgggaagtgaagtcagtgcctcagttgctgaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaagtaagtactgta

SEQ ID NO: 169224 - DNA, 585 bp, Homo sapiens
  Payload ID: 13311
  Gene Symbol: PDCD10
  Gene Name: programmed cell death 10
  ENST ID: ENST00000464360
  CDS Start-End: 349-585
gaagtgaagtcagtgcctcagttgctgaggagcactggaagaaggaagagacaaatgttggggtctacggattcagttccagtttaatgatgtggccctctaaggagataattttgccttaaacagaaagacttgaccctcttaggtgtcatacctaagctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcc

SEQ ID NO: 169225 - DNA, 1360 bp, Homo sapiens
  Payload ID: 13311
  Gene Symbol: PDCD10
  Gene Name: programmed cell death 10
  Uniprot ID: Q9BUL8
  ENST ID: ENST00000473645
  CDS Start-End: 324-962
gcacgactccggctgggcaggattccggacaacgcctggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgt

SEQ ID NO: 169226 - DNA, 686 bp, Homo sapiens
  Payload ID: 13311
  Gene Symbol: PDCD10
  Gene Name: programmed cell death 10
  ENST ID: ENST00000492139
  CDS Start-End: 285-686
gtgggaagtgaagtcagtgcctcagttgctgggaagaggagcactggaagaaggaagagacaaatgttggggtctacggattcagttccagtttaatgatgtggccctctaaggagataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatata

SEQ ID NO: 169227 - DNA, 934 bp, Homo sapiens
  Payload ID: 13311
  Gene Symbol: PDCD10
  Gene Name: programmed cell death 10
  Uniprot ID: Q9BUL8
  ENST ID: ENST00000461494
  CDS Start-End: 230-868
aggttggcccctggtgccccgggagaggggacagggcggatgtgcctggggtggggtcctttgaaggtgtggcttcggaccgagaggtgaggctgctgttttccccctgctttatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaatttt

SEQ ID NO: 169228 - DNA, 716 bp, Homo sapiens
  Payload ID: 13311
  Gene Symbol: PDCD10
  Gene Name: programmed cell death 10
  ENST ID: ENST00000487947
  CDS Start-End: 141-701
gaaggtgtggcttcggaccgagagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaagtaagtactgtaatttatc

SEQ ID NO: 169229 - DNA, 430 bp, Homo sapiens
  Payload ID: 13311
  Gene Symbol: PDCD10
  Gene Name: programmed cell death 10
  ENST ID: ENST00000479121
  CDS Start-End: 1-367
gcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaagcacttgaacaccaaaagaaagaatttgtaaagtactccaaaagtttcagtgatactctgaaaacgtattttaaagatggcaagtaagtactgt

SEQ ID NO: 169230 - DNA, 715 bp, Homo sapiens
  Payload ID: 13311
  Gene Symbol: PDCD10
  Gene Name: programmed cell death 10
  ENST ID: ENST00000462725
  CDS Start-End: 276-715
gggacagggcggatgtgcctggggtggggtcctttgaaggtgtggcttcggaccgagaggtgaggctgctgttttccccctgctttctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataa

SEQ ID NO: 169231 - DNA, 757 bp, Homo sapiens
  Payload ID: 13311
  Gene Symbol: PDCD10
  Gene Name: programmed cell death 10
  ENST ID: ENST00000494502
  CDS Start-End: 248-427
gatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaagggcaaaaaggaaagaaaatcatcagcataatgattaaaattggcaggcatcctacaggaaacaaacatcaagtgtgattacagaatttactgggaaaaactgaaatctgaagattaactctggctttggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttc

SEQ ID NO: 169232 - DNA, 1276 bp, Homo sapiens
  Payload ID: 13311
  Gene Symbol: PDCD10
  Gene Name: programmed cell death 10
  Uniprot ID: Q9BUL8
  ENST ID: ENST00000497056
  CDS Start-End: 242-880
cggctgggcaggattccggacaacgcctggttcctcttgggtccttccggcgtcgccggagtgaattgatccgggagttgaagagggctgcaaggtgggaagtgaagtcagtgcctcagttgctgatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagacctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatct

SEQ ID NO: 169233 - DNA, 6453 bp, Homo sapiens
  Payload ID: 13312
  Gene Symbol: PDCD11
  Gene Name: programmed cell death 11
  Uniprot ID: Q14690
  ENST ID: ENST00000369797
  CDS Start-End: 95-5710
ggactgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatgctacttacaggtaccgtatccagcctggaagaccatggctacctagtggacattggtgttgatgggaccagagcttttctgccactgctgaaagcccaggagtacatcagacagaagaacaaaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtgactccatttggccttacgctaaacttcctcacattcttcacgggcgtggttgactttatgcacctggatcccaagaaagctggaacatatttctcaaatcaggcagtgagggcctgcatcctttgcgtccatcctcgaaccagagttgtgcacctgagcctgcgccccatcttcctacagcctggacgcccactcacccgactctcttgccagaaccttggagcagtgctggatgatgttcctgtccagggttttttcaaaaaggctggggccacctttaggctgaaggatggggttctggcctatgcccggctcagccatctctctgattctaagaacgtcttcaatcctgaggccttcaagccagggaacactcacaagtgtagaattattgactacagccaaatggatgaactggccttgctctctctacgaacgtctattattgaagctcagtaccttagatatcatgacatcgaacctggggcagtggtaaagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtggtgaaggttgtcgtattgaactgtgagccatccaaagagaggatgctcttatccttcaagctgtcgagtgatccagagccaaagaaagagcctgcaggacacagtcagaagaaaggaaaagccattaacattgggcagttggtagatgtgaaggttttagagaagaccaaagatgggctggaggtggctgtcctgccccacaacatccgtgctttcctccccacatctcatctgtcggaccacgttgccaacggcccattgttacatcattggctccaggcaggtgacatccttcaccgagtcctgtgtctgagccagagcgaggggcgtgttcttctttgcaggaagccagccttggtctccacagtagaaggtggccaggatcccaagaacttctcagaaatccatcctggaatgctgctcattggttttgtgaagagcatcaaggactatggcgtgttcatccagttcccctcaggtcttagcggactggccccaaaagctatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgagactctgtgttgatccagacgctggccgagatgaccccaggaatgttccttgacctagtggtgcaggaggtgttggaagatggctctgtggtattcagtgggggtccagtgcccgacctggtcctgaaagccagcagataccatcgcgcagggcaggaggtggaatctgggcagaaaaagaaggttgttatcttaaatgttgatcttttgaagttggaagtgcacgtttcccttcaccaggacttggtgaatagaaaagctagaaagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatctcccaataagtcaccccagattcgttcgaaccatcccggagctgagtgttcggccaagtgagctggaggatggccacactgctcttaacactcactctgttagccccatggagaagattaaacagtaccaggccggccagactgttacttgcttcttaaagaaatacaatgtggtgaagaaatggcttgaggtggagattgccccagacatccgggggagaattcccttattgctcacttctctgagcttcaaggttctgaagcatccagataagaagttccgggttggccaggccctgagggccaccgttgttggcccagattcctccaagaccctcttatgtctgtccctcacaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcagatgttacatcctgtccactgcagacaacgtattgactttgtcgctgcgatcatccagaacaaacccggagacgaaaagcaaagtagaagatccagagattaactccatccaggacattaaggaagggcagcttctgaggggctatgtagggtccatccagccacacggtgtgttctttcgccttggcccctccgttgtgggtttggctcggtactcccatgtctcccagcacagcccgtccaagaaagccctttataacaaacacctccctgaagggaagctgctcacagccagggtcctacgccttaaccaccagaagaacctggtagagctgtctttcctccccggagacactgggaagccagacgtgctttctgcttccttggaagggcaacttacaaagcaagaggagaggaaaacagaggctgaggagagagaccaaaaaggggaaaagaaaaatcagaaaaggaacgagaagaagaaccagaaggggcaggaggaggtggagatgcccagcaaggagaagcaacagccccagaagccacaggcgcagaagcggggcgggcgggagtgccgggagtctgggagtgagcaggaaagagtgagcaagaagccaaagaaagccggcctgtcagaggaggacgacagccttgtggacgtgtactatcgggagggaaaagaggaggcagaagagacgaatgtgctgcccaaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacgataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggaagctggtgaactctacaaccggatgctgaagcgtttccggcaggagaaagctgtgtggatcaaatacggcgccttccttctgcggaggagccaggctgcagccagtcaccgcgtgctgcagcgagccctggagtgcctgcctagcaaggagcatgtggatgtcattgccaagtttgcccagcttgagtttcagctgggggatgcagagcgggccaaagccatttttgagaacacgctgagcacctacccaaagcgcacagatgtctggtcggtctatatcgacatgaccatcaagcacggcagccagaaggacgtccgggacatctttgagcgggtcattcatctgagcttggcccccaagagaatgaagttcttcttcaagcgctacctggactacgagaagcagcatggcactgagaaggatgtgcaggcagtcaaggccaaggccctggagtatgtggaggccaagagctcagtgctagaggactagtggcaggctggctctgtgggacactgtcaacaatgggccagcccggccccgcctcgagtgcctgggcactcggaaaactgttacctcaggactctatttaaatgctgctttttctgcagcacgcttggggaaatcctgtcaggatgaaaaggaagttgagattttttaaatccctcttcgcttgctttattttcagtaccaacttgttatctttttccttatctgaggctacctggggattgtgggcagcaggcccctggactcccagaaatgctgagggtccctcttccaggggagttccctggggagcaagagtagaggggctattcccgagggtcctgtggtcagggtcctgctttgtccctggcaggctgtcagtccagctggagggggtcagtaggctccagggagtgggccctcccctccgatcttggagtctctgggtgttccttcagcctcagcctcactggtaccttctgccctttaggggaggctatgagtctgggacaggaggacaaattcagagcccagagggggaaatggagaaacctgggctgctgaggaaagccacgggtgttggcgtgaactgatgatgtctcatcccacgcccactatggccacattacctaacctctccatatctgggctattcaaggtcttggaggccagcacagacccagctagttgttgaagccagttcttttttgtcttggtcatgagggaattaaacgttttctctggca

SEQ ID NO: 169234 - DNA, 732 bp, Homo sapiens
  Payload ID: 13312
  Gene Symbol: PDCD11
  Gene Name: programmed cell death 11
  ENST ID: ENST00000493610
  CDS Start-End: 93-209
actgtgggtatcctggtctccgcgtgtgtgagtaccgcggcgcgaggttagtggtagctgggtgcagacgccgtggcgctggagacccaaacatggcaaacctggaagaaagcttcccccgaggaggtacaagaaagatccacaaaccagagaaagctttccagcagtcagttgaacaagacaacttatttgatgtctgtattatgtaatcttttcaactgtactgtgaagcactgattgcaattccatgatgaggaacagtgtcttgctctgtcgcccaggctgaagtgcagtgttgtgatctcagctcactgcaacctccacttcttggttcaagcaattctcctgtatcagcctcccgagtacctgggactatagatttctactgaagagggatccaccaaaagaaaaaagagccagaaggggccagcaaaaacaaaaaagttgaaaatcgaaaagagagaaagcagcaagtccgcaagagagaagtttgaaatccttagtgttgagtccctgtgtgagggaatgcgtattttgggttgcgtgaaagaggtgaatgaactggaactggtgattagtctccccaatggcctccagggctttgtgcaagtcactgaaatctgtgatgcctacaccaaaaagctgaatgagcaggtgacacaagaacaacctctgaaggacctacttcacttgcctgaacttttctcacctggaatgctggtaagatgtgtg

SEQ ID NO: 169235 - DNA, 1118 bp, Homo sapiens
  Payload ID: 13313
  Gene Symbol: PDCD2
  Gene Name: programmed cell death 2
  ENST ID: ENST00000167218
  CDS Start-End: 65-730
cggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacagattgct

SEQ ID NO: 169236 - DNA, 936 bp, Homo sapiens
  Payload ID: 13313
  Gene Symbol: PDCD2
  Gene Name: programmed cell death 2
  Uniprot ID: Q16342
  ENST ID: ENST00000392090
  CDS Start-End: 1-936
atggctgccgccggggccaggcctgtggagctgggcttcgccgagtcggcgccggcgtggcgactgcgcagcgagcagttccccagcaaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaa

SEQ ID NO: 169237 - DNA, 1897 bp, Homo sapiens
  Payload ID: 13313
  Gene Symbol: PDCD2
  Gene Name: programmed cell death 2
  Uniprot ID: Q16342
  ENST ID: ENST00000443345
  CDS Start-End: 74-661
cttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatacttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagtagccaacatttatccagcacttaccttatataaagggctgtttgtgcatgagctcattaaaatcgtgacagcagaccaatgagtgagaaactgccccattttgaaggtgaggaaattgaggttctgggtataactttctttggtcacataatattaaattttacaatttgagccttgagccatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaa

SEQ ID NO: 169238 - DNA, 2657 bp, Homo sapiens
  Payload ID: 13313
  Gene Symbol: PDCD2
  Gene Name: programmed cell death 2
  Uniprot ID: Q16342
  ENST ID: ENST00000453163
  CDS Start-End: 32-718
gggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatacttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagtagccaacatttatccagcacttaccttatataaagggctgtttgtgcatgagctcattaaaatcgtgacagcagaccaatgagtgagaaactgccccattttgaaggtgaggaaattgaggttctgggtataactttctttggtcacataatattaaattttacaatttgagccttgagccatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactagactgttgcttttattttgagatggttgtgtgtgtattggggggaaaggaaacgagtaattatgttggtgttactgagaactgagatgttgggcgtaggaggaagataatgttgattgtgtctacgtaccatttctctctaaaaggaactccaggctctttggagaggtggttgattccagaactaggtcaggaaacgttcatataatgtgggaacatggtcatatcaaagattaaggataaggattactagggccatgtcagaactcaagcaacatgaaaaggctcctgcttgcaaaagatggacagtttgaacatccacaaggacgctaactgcatcagatatgtttaatgggttcaaaatgatactttaaaaaaactcagtaatcatctttataggatacttgggaacagactcattttcaaattggtaaataaaaggaaagagtttgccttcgaggggtacataacttaattatgaatgaagtgatatgtgtggaatttacttcagagtaatggaggtggaagtggcagagaaaggaaacactggacttgatagtgttgaaactgattaatgatatgtggcggttcattatagtatttccacttttctgtatgtccaaaattttctaaaataaaaggagaattgaatagaaaaa

SEQ ID NO: 169239 - DNA, 445 bp, Homo sapiens
  Payload ID: 13313
  Gene Symbol: PDCD2
  Gene Name: programmed cell death 2
  ENST ID: ENST00000539212
  CDS Start-End: 1-123
ttcctgctgcaggtgtatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggattcttagatatggcagaggtattgcccccatctggatttctggtgaaaatattcctcaagaaaaggatattccagattgcccctgtg

SEQ ID NO: 169240 - DNA, 3378 bp, Homo sapiens
  Payload ID: 13313
  Gene Symbol: PDCD2
  Gene Name: programmed cell death 2
  Uniprot ID: Q16342
  ENST ID: ENST00000541970
  CDS Start-End: 80-1114
tcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacagattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagcaaaaaaaaaaaaagttccaagtgtttttggcaa

SEQ ID NO: 169241 - DNA, 1082 bp, Homo sapiens
  Payload ID: 13313
  Gene Symbol: PDCD2
  Gene Name: programmed cell death 2
  ENST ID: ENST00000542896
  CDS Start-End: 32-928
gggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccagttttcagacacggtctattgactgacttctgtgacaatgaggatatctacactgctctccacctccagtgtggttatgtcattattattagtgcctctgttaacttttgttattttaaataatgtataccttcctttcttgttctagtaattaaagtctttgactatatacttta

SEQ ID NO: 169242 - DNA, 582 bp, Homo sapiens
  Payload ID: 13313
  Gene Symbol: PDCD2
  Gene Name: programmed cell death 2
  ENST ID: ENST00000544755
  CDS Start-End: 1-140
gcggccgcccgctctccttcctgctgcaggtgtatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatacttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagaca

SEQ ID NO: 169243 - DNA, 1114 bp, Homo sapiens
  Payload ID: 13313
  Gene Symbol: PDCD2
  Gene Name: programmed cell death 2
  Uniprot ID: Q16342
  ENST ID: ENST00000537445
  CDS Start-End: 35-601
tgtgggctgcgccccacgccagcccgcgccccgcatggctgccgccggggccaggcctgtggagctgggcttcgccgagtcggcgccggcgtggcgactgcgcagcgagcagttccccagcaaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactaga

SEQ ID NO: 169244 - DNA, 710 bp, Homo sapiens
  Payload ID: 13313
  Gene Symbol: PDCD2
  Gene Name: programmed cell death 2
  ENST ID: ENST00000544866
  CDS Start-End: 1-108
tatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccagttttcagacacggtctattgactgacttctgtgacaatgaggatatctacactgctctccacctccagtgtggttatgtcattattattagtgcctctgttaacttttgttattttaaataatgtataccttcctttcttgttctagtaa

SEQ ID NO: 169245 - DNA, 900 bp, Homo sapiens
  Payload ID: 13313
  Gene Symbol: PDCD2
  Gene Name: programmed cell death 2
  ENST ID: ENST00000545869
  CDS Start-End: 25-324
gccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaat

SEQ ID NO: 169246 - DNA, 560 bp, Homo sapiens
  Payload ID: 13313
  Gene Symbol: PDCD2
  Gene Name: programmed cell death 2
  ENST ID: ENST00000538195
  CDS Start-End: 496-560
agggggacggcggcaagcaccgctgccgccccagcctcagagctccctctccgcgctgccccaggagcaccttctcccgggcccttccaggatgtgctcatttttgctacataagcttctaactgtgcccacgcgcattggtaacccccagcttttaatcagtgggtaccagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttga

SEQ ID NO: 169247 - DNA, 1164 bp, Homo sapiens
  Payload ID: 13313
  Gene Symbol: PDCD2
  Gene Name: programmed cell death 2
  ENST ID: ENST00000544336
  CDS Start-End: 112-411
tccgcctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattacta

SEQ ID NO: 169248 - DNA, 1287 bp, Homo sapiens
  Payload ID: 13313
  Gene Symbol: PDCD2
  Gene Name: programmed cell death 2
  ENST ID: ENST00000614056
  CDS Start-End: 112-777
tccgcctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattact

SEQ ID NO: 169249 - DNA, 1171 bp, Homo sapiens
  Payload ID: 13314
  Gene Symbol: PDCD2L
  Gene Name: programmed cell death 2-like
  Uniprot ID: Q9BRP1
  ENST ID: ENST00000246535
  CDS Start-End: 48-1124
cagagaggccgccgtagtttgcgttttcacctggtcgcccggcggccatggcggccgttctgaagccggtgctgctgggccttcgagatgcgccggtgcacggcagccccacagggccgggtgcctggactgctagcaagctgggcggcattccggatgctctgcccaccgtggctgcgcccaggcccgtgtgtcagcgctgcgggcagccgctcgctctggtcgtgcaggtgtattgcccgctggaaggctccccgtttcaccgtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctgcaggatgctgtcctgggtgctgcccatcctgtgcctcctgggctgccgctcttcctgccctactacatctgtgttgcagatgaggatgattacagggactttgtcaacctggatcatgcccacagccttctgagggactatcagcagagagaaggcattgccatggatcagttgctttcccaaagccttcctaatgatggtgatgaaaaatatgagaagaccataattaaaagtggagatcagacgttttacaaattcatgaagcgaattgctgcttgtcaggagcagattttgaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaa

SEQ ID NO: 169250 - DNA, 492 bp, Homo sapiens
  Payload ID: 13314
  Gene Symbol: PDCD2L
  Gene Name: programmed cell death 2-like
  ENST ID: ENST00000587065
  CDS Start-End: 274-444
agtcccagagctgctccaggggtgtcctttccagcgggctggggcgggccggcgggctggagtcggggtgcagccctcacggccctttgtcttcaccccgaagctggaaggtgttccgctcccagtgcctgcaggtgccagagagagaggcgcaggacgctcaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaaa

SEQ ID NO: 169251 - DNA, 3602 bp, Homo sapiens
  Payload ID: 13315
  Gene Symbol: PDCD4
  Gene Name: programmed cell death 4 (neoplastic transformation inhibitor)
  Uniprot ID: Q53EL6
  ENST ID: ENST00000280154
  CDS Start-End: 275-1684
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaaataaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 169252 - DNA, 3697 bp, Homo sapiens
  Payload ID: 13315
  Gene Symbol: PDCD4
  Gene Name: programmed cell death 4 (neoplastic transformation inhibitor)
  Uniprot ID: Q53EL6
  ENST ID: ENST00000393104
  CDS Start-End: 404-1780
cttttcctcctcagctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagggtattttccctaattctccatggtgcttcaatagcatgttattatcataaaaatgaacagttttgtggaatagatgaccaaatatcctgataacttaagtgactctctcttttccggtgatgaagaaaatgctgggactgaggaaataaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgt

SEQ ID NO: 169253 - DNA, 819 bp, Homo sapiens
  Payload ID: 13315
  Gene Symbol: PDCD4
  Gene Name: programmed cell death 4 (neoplastic transformation inhibitor)
  ENST ID: ENST00000444997
  CDS Start-End: 127-819
cagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagaaaatgctgggactgaggaaataaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaa

SEQ ID NO: 169254 - DNA, 558 bp, Homo sapiens
  Payload ID: 13316
  Gene Symbol: PDCD5
  Gene Name: programmed cell death 5
  ENST ID: ENST00000221784
  CDS Start-End: 61-228
cgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaa

SEQ ID NO: 169255 - DNA, 154 bp, Homo sapiens
  Payload ID: 13316
  Gene Symbol: PDCD5
  Gene Name: programmed cell death 5
  ENST ID: ENST00000379316
  CDS Start-End: 6-128
gagccatggcggacgaggagcttgaggcgctgaggagacagaggctggccgagctgcaggccaaacacggggatcctggtgatgcggcccaacaggaagcaaagcacagttcaacagaagaaaagtaatggactctgatgaagatgacgattat

SEQ ID NO: 169256 - DNA, 699 bp, Homo sapiens
  Payload ID: 13316
  Gene Symbol: PDCD5
  Gene Name: programmed cell death 5
  Uniprot ID: O14737
  ENST ID: ENST00000590247
  CDS Start-End: 195-572
ccgtgcgcccaagctcgaccgcctgaaatcggggaatcgggcctctgccggcgccctggcagcggcgcggggcgtggctccgggctggattggtggcgcctgggccccgcgagcgcctgcgcagtggtcaaggccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaca

SEQ ID NO: 169257 - DNA, 601 bp, Homo sapiens
  Payload ID: 13316
  Gene Symbol: PDCD5
  Gene Name: programmed cell death 5
  ENST ID: ENST00000586035
  CDS Start-End: 224-487
gggggccgccacgtgcgggacctgccctggcgttggggtgtggggtcccctagcctggagcgggctcgtcctggcgggcctggatccaagcacaatctcagcttttggagccagcagccggaccgaattcagtttttccggagttcagttgttatgacccaagtttagccgacaggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttat

SEQ ID NO: 169258 - DNA, 468 bp, Homo sapiens
  Payload ID: 13316
  Gene Symbol: PDCD5
  Gene Name: programmed cell death 5
  ENST ID: ENST00000592786
  CDS Start-End: 31-228
ccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggtgtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaacatttgggtaagttgttttagtatcat

SEQ ID NO: 169259 - DNA, 1799 bp, Homo sapiens
  Payload ID: 13316
  Gene Symbol: PDCD5
  Gene Name: programmed cell death 5
  Uniprot ID: O14737
  ENST ID: ENST00000419343
  CDS Start-End: 62-451
ccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtaagcttagacagccttgaggaactttactgttacctgctttatcaaaacatggcttcaaaaggtcagctgcatcttcactggattacagaattcttgctgactctcagaagaaattgttggagagaatagtcatacctactttaaaagagaataaattgcctttcctaaattcctctgcttcgctcctttcctggcgttgctctggaaccttgttggtgtctgtgacccaatgactgttagggtcagctagcttcaattgcccctgcactggaagcaaggtttgtcagtaacaccaattaaaatactaccagtgtaagtagaaggtgtgttttgcagatgagaaggtgctaagatgccttgcttatgttctctgtgttgctgtaataccatgaggggtatgttgtggcaaacctggcctttgagatcaagacgaaccccacctgccctgagaagccgtctgctaccaccacagcctacccgaattggtcctgtcccctaaacccctcacactgagaactgcttgtgtgggagagagctggttgggttgatcttttccgagtgtgacttacctccttcaaggggatgtttaagcttctcgggcagaagtggtgtgtctattcctgacaccaaacaccgtggtatatgtggttgtcacactcagctagtgatgataaaggtgttcttaaatatgttagctttcagttttcctgaggaagcaattttatggatacttccccctccttctcaagtgaggaatagcagagcaaattttatttggaacttaaaccaatagttataaccaatagtttcaacctcctgcctcaccactgcttccttcctgagctctttccccacacctcaaaaagagtacaaagtgattccatctgcagaggtaaattctttgtttaaaaaagtactgtttttcttatcttttctggttctcctaggtatcagaacaaggtttaatagaaatccttaaaaaagtaagccaacaaacagaaaagacaacaacagtgaaagtaagtgtccccagatgcttgtggcaaatgaaaagatggatactttaaagattaatgttgagtatacatctaccacacatatttttcagcccagagacattttccttttgtcaaacacgtgaaagtttggggagaaaggctgaatctgttgggggagggttctaatttttataggctcttgactccattcccacccttttagttcacgctaagttgctttaaagacacaaatgtcttgctaaaattggtagaaatcttttctcggaaaatctgagttatgctttattagaaatgttctgacactcatttaattttcctcccagttcaacagaagaaaagtaatggactctgatgaagatgacgattattgaactacaagtgctcacagactagaacttaacggaacaagtctaggacagaagttaagatctgattatttactttgtttattgtctata

SEQ ID NO: 169260 - DNA, 1135 bp, Homo sapiens
  Payload ID: 13317
  Gene Symbol: PDCD6
  Gene Name: programmed cell death 6
  Uniprot ID: O75340
  ENST ID: ENST00000264933
  CDS Start-End: 101-676
gataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgt

SEQ ID NO: 169261 - DNA, 672 bp, Homo sapiens
  Payload ID: 13317
  Gene Symbol: PDCD6
  Gene Name: programmed cell death 6
  Uniprot ID: O75340
  ENST ID: ENST00000505221
  CDS Start-End: 75-284
gaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatataggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttc

SEQ ID NO: 169262 - DNA, 1156 bp, Homo sapiens
  Payload ID: 13317
  Gene Symbol: PDCD6
  Gene Name: programmed cell death 6
  ENST ID: ENST00000509581
  CDS Start-End: 65-232
cggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggatgaagccccacccgcccttcaggatgccagccttggcaacattgtgagaccctgtttctacaaaaagtaaatgagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgcgctgctcctgccattggatcatcgcagcatttttcttttctctgatatgcacctttttcctcatcgtgggggctcacgttttcatagttccctctcactactaggttgtgagctgcgtgaaggaaggttcatagttgtgttgtatgtacaggcacacaaaatttgtccttggataaacacatatcctcttccttcttctctctgaatttctttattttaagaaaaaaattagagatggagtctcactgtcttgctcaggctggtctcaaactcctaggctcaagtgatcctcctgcctcagcctatactaatatgaattcctatactaatatgattgaaattagtttgatttctataataattgtgctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccacactgagaaggtatttgtggcccatacactgattccttcatgagacttgtttgcacaggagagctgctaaaaattactgctctcagggaggtctgtggtgaacaggtatgaagaagaagactgttctctgcccttctttttgcaataaaatgttccaaacta

SEQ ID NO: 169263 - DNA, 1088 bp, Homo sapiens
  Payload ID: 13317
  Gene Symbol: PDCD6
  Gene Name: programmed cell death 6
  Uniprot ID: O75340
  ENST ID: ENST00000507528
  CDS Start-End: 65-634
cggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttaga

SEQ ID NO: 169264 - DNA, 1484 bp, Homo sapiens
  Payload ID: 13317
  Gene Symbol: PDCD6
  Gene Name: programmed cell death 6
  ENST ID: ENST00000505526
  CDS Start-End: 61-180
gtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagaggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagattgccttcgacgacttcatccagggctgcatcgtcctgcaggtgacggaatggcttcacgtgggtttgtggtggtggtgggaggggcttgcttgccagcgtgatgcacctgaccttcaatctaaggagctgggcatgtgtagaattagtttttggagcttataaaagtgagtctcatctttggagaagtagccggttagtgaagtgtggacaaacatgttttcctccccttggaaatggcacagagcagcccatctgcaagacgtggtttttcagtatccggtgggttatttacatgtatgttctggtgttgtggttttttttgttttttgttttgttttgttttgttttgagaccgagtctcgctctgtcacccagacgggagtgcagtggcacgatcccggctcactcccacctctgcgtcccgggtttaagcaattctcctgcctcagcctccccagtagctgggattacaggtgacacccagctaatttttgtatttttagtagagacgggattttgccatgttggccaggctgatctcaaactcctgacctcaagtaatccgcccaccttagcctcccaaagtgctaggattacagacatgagccaccatgcctggccaactatggtgtatttttacaaaaacttttattctgagaaaatgggcacgttttctgttgtggtcatcactgtgtcctgccgtctgtgtgtgaggtcagctgtggagcctgtggtcgctcaggccgccctcagtggggtctccgagctcttcccgtgcactccagtgtctgcaggagctggtaatgcaccctgacctgcaaggcaagctccttggtggtgtctctcctgctgggctctctttgagacccacgggagatggagagcagggctcaggggacccgcctgggagctccacacagacctctgctgctgtttgcaggtggtgatccaggtctctacccaggttcctcaaggtcctgtcttgttggccttggaattcagtgagagataggaacagcatggggtttttagaaataatgtggaaatt

SEQ ID NO: 169265 - DNA, 486 bp, Homo sapiens
  Payload ID: 13317
  Gene Symbol: PDCD6
  Gene Name: programmed cell death 6
  ENST ID: ENST00000507473
  CDS Start-End: 1-315
gtcgataaagacaggagtggagtgatatcagacaccgagcttcagcaagctctctccaacggcacgtggactccctttaatccagtgactgtcaggtcgatcatatgctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaact

SEQ ID NO: 169266 - DNA, 458 bp, Homo sapiens
  Payload ID: 13317
  Gene Symbol: PDCD6
  Gene Name: programmed cell death 6
  ENST ID: ENST00000506909
  CDS Start-End: 52-273
agaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaag

SEQ ID NO: 169267 - DNA, 931 bp, Homo sapiens
  Payload ID: 13317
  Gene Symbol: PDCD6
  Gene Name: programmed cell death 6
  ENST ID: ENST00000618970
  CDS Start-End: 101-472
gataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgt

SEQ ID NO: 169268 - DNA, 1050 bp, Homo sapiens
  Payload ID: 13317
  Gene Symbol: PDCD6
  Gene Name: programmed cell death 6
  ENST ID: ENST00000614778
  CDS Start-End: 226-591
gataatgccaggccctgcccccggcagaggcggaagcggagtcggcctgagaggtctctcgtcgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgt

SEQ ID NO: 169269 - DNA, 1073 bp, Homo sapiens
  Payload ID: 13317
  Gene Symbol: PDCD6
  Gene Name: programmed cell death 6
  ENST ID: ENST00000628729
  CDS Start-End: 101-220
gataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagaggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgt

SEQ ID NO: 169270 - DNA, 6161 bp, Homo sapiens
  Payload ID: 13318
  Gene Symbol: PDCD6IP
  Gene Name: programmed cell death 6 interacting protein
  Uniprot ID: Q8WUM4
  ENST ID: ENST00000307296
  CDS Start-End: 378-2984
agtacttctccggggggttgttcgagtggaggaatactcttacgtgaaagtgctcagtacaccactgcggcaggaaggaggaagggaagaattccagatggggagaaagtaatattttgcagcacagtacagggtaaactgggtccaggtgggcgtagccgccgcgacaccttcacgtgaccgcggacagcttaaggaccccgcatccagtgcgcctgcgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggagtattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattctt

SEQ ID NO: 169271 - DNA, 587 bp, Homo sapiens
  Payload ID: 13318
  Gene Symbol: PDCD6IP
  Gene Name: programmed cell death 6 interacting protein
  ENST ID: ENST00000435909
  CDS Start-End: 119-337
gagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagcc

SEQ ID NO: 169272 - DNA, 582 bp, Homo sapiens
  Payload ID: 13318
  Gene Symbol: PDCD6IP
  Gene Name: programmed cell death 6 interacting protein
  ENST ID: ENST00000430877
  CDS Start-End: 109-345
ctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgaggctggtctcgaactctgggctcaagtgatccacctgcctcagcctcccagagtgctaggattacaggcgtgatctgctgtgcctggccctttcagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaatt

SEQ ID NO: 169273 - DNA, 566 bp, Homo sapiens
  Payload ID: 13318
  Gene Symbol: PDCD6IP
  Gene Name: programmed cell death 6 interacting protein
  ENST ID: ENST00000413073
  CDS Start-End: 107-566
gtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagaacctggataatgatgaaggattgaaaatcgctgctaaacattaccagtttgctagtggtgcctttttacatattaaagagacggttttatctgccttaagtcgagagccgaccgtggacatatctccagatactgttgggaccctcagtcttattatgctggcacaggctcaagaagtattttttttaaaagcca

SEQ ID NO: 169274 - DNA, 5962 bp, Homo sapiens
  Payload ID: 13318
  Gene Symbol: PDCD6IP
  Gene Name: programmed cell death 6 interacting protein
  Uniprot ID: Q8WUM4
  ENST ID: ENST00000457054
  CDS Start-End: 159-2780
gctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgagatattatgatcagatttgttctattgaacccaaattcccattttctgaaaatcagatctgcttgacatttacctggaaggatgctttcgataaaggttcactttttggaggctctgtaaaactggctcttgcaagcttaggatatgaaaagagctgtgtgttgttcaattgtgcagccttagctagccaaattgcagcagaacagaacctggataatgatgaaggattgaaaatcgctgctaaacattaccagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaagtatttttatttccaggaggtgttccctgtcttggctgcaaagcactgtatcatgcaggccaatgctgagtaccatcagtctatcctggcaaaacagcagaagaaatttggagaagaaattgcaaggttacagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggggtgctagcttcccttaatcttccagcagcaattgaagatgtgtctggagacactgtacctcagtctatattgactaaatccagatctgtgattgaacagggaggcatccagactgttgatcagttgattaaagaactgcctgaattactgcaacgaaatagagaaatcctagatgagtcattaaggttgttggatgaagaagaagcaaccgataatgatttaagagcaaaatttaaggaacgttggcaaaggacaccatccaatgaactgtataagcctttaagagcagagggaaccaacttcagaacagttttagataaagctgtgcaggcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaatacttcataatgtaatggaattgtttggggaacacttactgtaccctctcatcctttttccaccttactgtgttaacttagtgacatttaatgcccaatatgtatgaatagatctaagccatttaattttttttccttaaagattggagtattttataattcaaggagcatacaaaacaatggttgggaacatatgccaattatggaataggctatgtatttaatattaatctctgccattaggatatctactcactgtataaacctcagtaaaaatagtgaagacatgcatcatggaatgagaaaatgagaaaggaatgagttgtctaacatcacagtgggatctgttttttgtgaggttcatttctgaacacattaggcatatgagcagatttccagtgaatctatttatgtttattttctgagtttcaacgctgaccttttcttgcattattgtttcattttaatgatagtgttacttgtcccactgttgttttcattgagtttggatttatattttaaatgttcgaatgaaagtatgattgtaaaagggagtgaattggtttaaaaatatatgtatattttaaactttgttgtgtgtaggaaacatgaaggcatgttaattcaatataaatgacctttgatttcatggaatattaaagttggtttaaagtccaatagttaaaccttagcaaaaatagctttttacttcatcagttgctaagatttaatactttggattcatcaaagtgtgacatgggcttgtttgacttctgtaagtggcatttaagttccacattcttattacttgaggtactttatactaacataagacagtgagagttagaggtattacaagttgctagtttataatgtcttactaatgcagaaacaaggaaaaaagcaaaattggcctgaatattctcttggggaaagagggcaccaaagaaaagggtaagtgcatctgagggccaaaagagatgtataagccttttagcccattccccatgctgggcctgctcacagagccacaggaagatcattcagaaactaggaaaggaggcccccacagctgatcctgccacagcacacctgactcactcggctctgttagtgtaaccttttaaatgtagcaacacaaaccctttccctcttgtcagttcactcatcctttggtttctttttaatcacctgtgtctgggcacagacaatcacaataaatgcagccctttattactgttaaggatcatactgttggtttggagttggaagggtactactctgtgattcaggtgtgttgtacccatatttataattaggctttattatcttcctaaatcaaggaaaggaaatcatccccagaccatttatgctgagctttggaatactattttaaactggattgtacttaaataatgaagctctgcatagaggaactagtcagaagtggggaaaacactgtctaatttttatcagtctggtataaagtattgatctaagagaactctccctgtgccccttggtctttattctcaattaagaaaaacagtcacatgtcacgacaaaccaatcaatctttatgagatattcctgtatccataccccagcttgtttgcaatttataaacctccccttcaaaactaaggagttgcagaaaaaaatggatttcacagagccttgtgtccctaaagttctgtcccagtcagcagtctttatagtccaaacagattataaaaaatgttttccatttgaactttacagtttgcaaaagtgcttttatacattttctaatttcagaaacaggataatttgttaagtgggtttcagtttgctaatagggattttttgtgttttgttttttaattttcagcatctcttgaagaatcttgctacagccaaatggcatctcactttttaaagacgtttgcaattattagttgattcacagtacagaacaaggtataaaggaaaaaaccctgctaggtagtgttataattgctagattaaaaatagactagaacaggttcattttaagatttacttggaagagcaaagaaggaaaaattatatttttaaagaaagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtccagatgaatgtatgctagaaataaaagttgaaagattcttacttc

SEQ ID NO: 169275 - DNA, 842 bp, Homo sapiens
  Payload ID: 13318
  Gene Symbol: PDCD6IP
  Gene Name: programmed cell death 6 interacting protein
  ENST ID: ENST00000412887
  CDS Start-End: 55-342
cgagagccgaccgtggacatatctccagatactgttgggaccctcagtcttattatgctggcacaggctcaagaagtattttttttaaaagccacaagagataaaatgaaagatgccatcatagctaaattggctaatcaggctgcagattattttggtgatgctttcaaacagtgtcaatacaaagatactctccccaaggaggtgttccctgtcttggctgcaaagcactgtatcatgcaggccaatgctgagtaccatcagtctatcctggcaaaacagcagaagaaatttggagaagaaattgcaaggttacagatccaccctttcactgagagttaggccgtttgaggttcctgccttcatgtgaaggagtgaaagagcatgcagcagaactgattaaaacagtggcatctcgctatgatgaatatgttaatgtgaaggatttttctgacaaaatcaatcgtgcccttgctgcagcaaagaaggataatgacttcatttatcatgatcgagttccagaccttaaagatctagatcctattggcaaagccacacttgtgaaatctaccccggtcaatgtacccatcagtcagaaatttactgatctgtttgagaagatggttcccgtgtcagtacagcagtctttggctgcctataatcagaggaaagccgatttggttaacagatcaattgctcagatgagagaagccaccactttggcaaatggtcattaaggttgttggatgaagaagaagcaaccgataatgatttaagagcaaaatttaaggaacgttggcaaaggacaccatccaatgaactgtataagcctttaagagcag

SEQ ID NO: 169276 - DNA, 2851 bp, Homo sapiens
  Payload ID: 13319
  Gene Symbol: PDCD7
  Gene Name: programmed cell death 7
  Uniprot ID: Q8N8D1
  ENST ID: ENST00000204549
  CDS Start-End: 56-1513
ctcatgaggagccactcagattcctgtcacttctcaaagcatctccgtcgtgaacatggccctgccaccattcttcggccagggtcgcccaggcccaccgcccccgcagccgccgcctcctgctcctttcggctgtccgccaccgccgctgccctccccggctttcccgccgcctctcccccagcggcccggcccttttccgggggcctccgcccccttccttcagcctccgctggctctgcagccccgagcctccgcggaggcctcccgcggcggaggcggcgctggcgccttctacccggtgccaccaccgccgctgcctcctccgccgccccagtgtcggcccttcccggggaccgacgccggcgagcggccgcggccaccgcctcccggcccggggccgccctggagcccgcggtggcctgaggcgccgccgccgccggccgacgtgctcggggatgcggccctccaacgcctgcgcgaccggcagtggctggaggcggtgttcgggaccccgcggcgggcaggctgtccggtgccccagcgcacgcatgccgggcccagccttggcgaagtgcgcgcgcgattgctccgggctctgcgcctggtgcggcggctgcgcggcctgagccaggccctgcgcgaggccgaagccgacggcgcggcctgggtcctgctgtactcccagaccgcgccgctgcgcgcggaactggccgagcggctacagccgttgacccaggctgcctatgtgggcgaggcgcggaggaggctggagagggtccggcgccgccggctgcggcttcgcgagagggcccgggaacgcgaggccgagcgggaggcagaggccgcgcgggcagtggaacgcgagcaggagattgaccgctggagggtgaagtgtgtgcaggaggtggaggagaagaagcgggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaaggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctccccagcaacgacatctgggcaactgctgttaagctgcattagtaaagatgctccaggagtgtggtccagccagcgctctttccagctgtaaatattagcgatggtgccatcttttgctgtagactaaactgcaacttctaaattccatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggattgtattttaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagtggctcacgcctgtaatcccaacactttgggaggccgaggcgggccgatcacgaggtcaggagatcaaggccatcctggctaacacggtgaaaccctgtctctactaaaaatacaaaaaaatattagctgggcgtaggtggtgcacacctgtagtcccagctactggggaggctgaggcaggagaatggtgtaaaacccaggaggcagagcttgcagtgagccgagatcgcgccacggcactccagcctgggagacagagcaagactccgtctcaaaaaaaaaaaaagtaaaatttattttttatattcattaataaatgctgttgtgcttggagatgatcactcatataacatgtcatttttttggttctgttttggtttggtttttgccaattattttgttatatttccaaaaaactaaataaaaatcatttttatttttta

SEQ ID NO: 169277 - DNA, 309 bp, Homo sapiens
  Payload ID: 13319
  Gene Symbol: PDCD7
  Gene Name: programmed cell death 7
  ENST ID: ENST00000560313
  CDS Start-End: 1-309
gagcaggaactcaaagcagccgctgatggcgtactatctgaagtgaggaaaaaacaagcagataccaaaagaatggtggacattctacgggctttggagaaattgaggaaactgaggaaagaggctgcagcgaggaaagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctc

SEQ ID NO: 169278 - DNA, 630 bp, Homo sapiens
  Payload ID: 13320
  Gene Symbol: PRCD
  Gene Name: progressive rod-cone degeneration
  Uniprot ID: Q00LT1
  ENST ID: ENST00000586148
  CDS Start-End: 53-217
cgcctgtggccttctgcagacttggcctgggaggggatggggcagctgcgccatgtgcaccacccttttcctgctcagcaccctggccatgctctggcgccgccgatttgccaaccgagtccaaccagagcccagcgacgtggatggggcagctaggggcagcagcttggatgcggaccctcagtcctcaggcagggagaaagaacctctgaagtaagccctcacctctgcaggtggggctcaggcccagagactgggatcagctggctcaggcaggtcctggttcgtcccctagcccaggaggatgctgtgggagctgcagcagcggcaagagggagaatggggggaagcagcactagagaaggtagacgcctccctctcagcccgggacctgccagtctccccttcccccaggccctgggtgtgggctcctgagcaggacctggctgggcctggcagaaagagcagacgtgctcgctgctctcggacgggcttccttccctctgagttcctgaggctcctctgagggactgctgagcctgagaaagcctaggatgagggacttgctgggtccaccaggctaattctggggcagccagcagcccaggcaagaggcaggaataagtaagg

SEQ ID NO: 169279 - DNA, 462 bp, Homo sapiens
  Payload ID: 13320
  Gene Symbol: PRCD
  Gene Name: progressive rod-cone degeneration
  Uniprot ID: Q00LT1
  ENST ID: ENST00000592014
  CDS Start-End: 110-274
aaccgcaggacagacggcagtggctcctgagagctggctggggccattttggcccctcgcctgtggccttctgcagacttggcctgggaggggatggggcagctgcgccatgtgcaccacccttttcctgctcagcaccctggccatgctctggcgccgccgatttgccaaccgagtccaaccagagcccagcgacgtggatggggcagctaggggcagcagcttggatgcggaccctcagtcctcaggcagggagaaagaacctctgaagtaagccctcacctctgcaggtggggctcaggcccagagactgggatcagctggctcaggcagctcaggtcctggttcgtcccctagcccaggaggatgctgtgggagctgcagcagcggcaagagggagaatggggggaagcagcactagagaagttcccagagctcatcctgtcactggctgctctgctg

SEQ ID NO: 169280 - DNA, 1832 bp, Homo sapiens
  Payload ID: 13321
  Gene Symbol: PHB
  Gene Name: prohibitin
  Uniprot ID: P35232
  ENST ID: ENST00000300408
  CDS Start-End: 74-892
agtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcattcagagactgcccttctcacgggctctatgcctgcactgggaaggaaacaaatgtgtataaactgctgtcaataaatgacacccagaccttccggctca

SEQ ID NO: 169281 - DNA, 907 bp, Homo sapiens
  Payload ID: 13321
  Gene Symbol: PHB
  Gene Name: prohibitin
  ENST ID: ENST00000419140
  CDS Start-End: 170-907
gcgcagtatgtgtggttggggaattcatgtggaggtcagagtggaagcagttatcttggccccaggatgtcatccagctcctgcttccataagaagcatgtcgttcttaatacacgatgttgacaagcagtatggtgaggaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggac

SEQ ID NO: 169282 - DNA, 732 bp, Homo sapiens
  Payload ID: 13321
  Gene Symbol: PHB
  Gene Name: prohibitin
  ENST ID: ENST00000446735
  CDS Start-End: 129-732
cagagtggaagcaggtgagaatggagggggcggcaaaggctcgtttctgggcatctctgcagtcctcctctgctccatgatgtgcactttgggcgaggagagtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaa

SEQ ID NO: 169283 - DNA, 534 bp, Homo sapiens
  Payload ID: 13321
  Gene Symbol: PHB
  Gene Name: prohibitin
  ENST ID: ENST00000434917
  CDS Start-End: 161-534
tgtgtggttggggaattcatgtggaggtcagagtggaagcaggtgagaatggagggggcggcaaaggctcgtttctgggcatctctgcagtcctcctctgctccatgatgtgcactttgggcgaggagagtgcgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactga

SEQ ID NO: 169284 - DNA, 694 bp, Homo sapiens
  Payload ID: 13321
  Gene Symbol: PHB
  Gene Name: prohibitin
  ENST ID: ENST00000512041
  CDS Start-End: 89-694
ctgggcatctctgcagtcctcctctgctccatgatgtgcactttgggcgaggagagtgcgtgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaag

SEQ ID NO: 169285 - DNA, 1509 bp, Homo sapiens
  Payload ID: 13321
  Gene Symbol: PHB
  Gene Name: prohibitin
  Uniprot ID: P35232
  ENST ID: ENST00000511832
  CDS Start-End: 99-566
gggcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcattcagagactgcccttctcacgggctctatgcctgcactgggaaggaaacaaatgtgtataaactgctgtcaataaatgacacccagaccttccggctcagcc

SEQ ID NO: 169286 - DNA, 796 bp, Homo sapiens
  Payload ID: 13321
  Gene Symbol: PHB
  Gene Name: prohibitin
  ENST ID: ENST00000504124
  CDS Start-End: 147-796
atgtggaggtcagagtggaagcaggtgagaatggagggggcggcaaaggctcgtttctgggcatctctgcagtcctcctctgctccatgatgtgcactttgggcgaggagagtgcgtgcgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcga

SEQ ID NO: 169287 - DNA, 1952 bp, Homo sapiens
  Payload ID: 13321
  Gene Symbol: PHB
  Gene Name: prohibitin
  Uniprot ID: P35232
  ENST ID: ENST00000614445
  CDS Start-End: 191-1009
gggcggggcagaggagctcatgcgcagtatgtgtggttggggaattcatgtggaggtcagagtggaagcagttatcttggccccaggatgtcatccagctcctgcttccataagaagcatgtcgttcttaatacacgatgttgacaagcagtatggtgaggaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcattcagagactgcccttctcacgggctctatgcctgcactgggaaggaaacaaatgtgtataaactgctgtcaataaatgacacccagaccttccggctcagcc

SEQ ID NO: 169288 - DNA, 1908 bp, Homo sapiens
  Payload ID: 13321
  Gene Symbol: PHB
  Gene Name: prohibitin
  Uniprot ID: P35232
  ENST ID: ENST00000617874
  CDS Start-End: 147-965
atgtggaggtcagagtggaagcaggtgagaatggagggggcggcaaaggctcgtttctgggcatctctgcagtcctcctctgctccatgatgtgcactttgggcgaggagagtgcgtgcgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcattcagagactgcccttctcacgggctctatgcctgcactgggaaggaaacaaatgtgtataaactgctgtcaataaatgacacccagaccttccggctcagcc

SEQ ID NO: 169289 - DNA, 1308 bp, Homo sapiens
  Payload ID: 13322
  Gene Symbol: PHB2
  Gene Name: prohibitin 2
  ENST ID: ENST00000399433
  CDS Start-End: 81-977
gcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcccagcaggaggcccagcgggcccaattcttggtagaaaaagcaaagcaggaacagcggcagaaaattgtgcaggccgagggtgaggccgaggctgccaagatgcttggagaagcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctg

SEQ ID NO: 169290 - DNA, 996 bp, Homo sapiens
  Payload ID: 13322
  Gene Symbol: PHB2
  Gene Name: prohibitin 2
  Uniprot ID: Q99623
  ENST ID: ENST00000440277
  CDS Start-End: 211-996
tccgtatgcgcgattcctgtgcgcgaagttcgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggggaagtgacagcctcatcaagggtaagaaatga

SEQ ID NO: 169291 - DNA, 872 bp, Homo sapiens
  Payload ID: 13322
  Gene Symbol: PHB2
  Gene Name: prohibitin 2
  ENST ID: ENST00000544888
  CDS Start-End: 138-476
acttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtgggtgagtcgcaagagccgtggggtgagggcttctgagatgcaggaggaggaaagactccatgggtggggctcctgacccaggacagggtctccctgactctctcccaccacagcccagcaggaggcccagcgggcccaattcttgg

SEQ ID NO: 169292 - DNA, 858 bp, Homo sapiens
  Payload ID: 13322
  Gene Symbol: PHB2
  Gene Name: prohibitin 2
  ENST ID: ENST00000546111
  CDS Start-End: 209-472
cgtatgcgcgattcctgtgcgcgaagttcgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcagatcgccacatcacagaatcgtatctatctcacagctgacaaccttgtgctgaacctacaggatgaaagtttcaccagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaa

SEQ ID NO: 169293 - DNA, 739 bp, Homo sapiens
  Payload ID: 13322
  Gene Symbol: PHB2
  Gene Name: prohibitin 2
  ENST ID: ENST00000536316
  CDS Start-End: 100-739
gaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcagggtagtgccaggctgtacaccattgcacagggcatacagggaggaacatgaaggagaaaatgcttgggaaagggtgtttggccttgaccagccactgctgacctcaatctcagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtgg

SEQ ID NO: 169294 - DNA, 1138 bp, Homo sapiens
  Payload ID: 13322
  Gene Symbol: PHB2
  Gene Name: prohibitin 2
  ENST ID: ENST00000542912
  CDS Start-End: 107-910
cgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcccagcaggaggcccagcgggcccaattcttggtagaaaaagcaaagcaggaacagcggcagaaaattgtgcaggccgagggtgaggccgaggctgccaagatgcttggagaagcactgagcaagaaccctggctacatcaaacttcgcaagattcgagcagcccagaatatctccaagacgcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttgggg

SEQ ID NO: 169295 - DNA, 908 bp, Homo sapiens
  Payload ID: 13322
  Gene Symbol: PHB2
  Gene Name: prohibitin 2
  ENST ID: ENST00000545167
  CDS Start-End: 125-908
tttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcagtgggtgctgcgagaacctccagcagcatacaaactgttgttttccagagggacaagagaatctctccttgtctgtggtcgtggagaggagcaggccaaaaaacgcgtggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcccagcaggaggcccagcgggcccaattcttggtagaaaaagcaaagcaggaacagcggcagaaaattg

SEQ ID NO: 169296 - DNA, 1515 bp, Homo sapiens
  Payload ID: 13322
  Gene Symbol: PHB2
  Gene Name: prohibitin 2
  Uniprot ID: Q99623
  ENST ID: ENST00000535923
  CDS Start-End: 283-1182
aggaaatggagatgacttgctgtcttgcgctgccctccctgggagggcagccttccagaaaggggcgggacttccgtatgcgcgattcctgtgcgcgaagttcgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcccagcaggaggcccagcgggcccaattcttggtagaaaaagcaaagcaggaacagcggcagaaaattgtgcaggccgagggtgaggccgaggctgccaagatgcttggagaagcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggggaagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaa

SEQ ID NO: 169297 - DNA, 309 bp, Homo sapiens
  Payload ID: 13322
  Gene Symbol: PHB2
  Gene Name: prohibitin 2
  ENST ID: ENST00000545555
  CDS Start-End: 1-309
ggatgatgtggccatcacagagctgagctttagccgagagtacacagctgctgtagaagccaaacaacccagaggaggactggagcaagggagtgtggtaaggacagggccagggattgagacctgcccttgcgtgtaccttaaccctcctcaccttggagaagcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccag

SEQ ID NO: 169298 - DNA, 1338 bp, Homo sapiens
  Payload ID: 13323
  Gene Symbol: PROK1
  Gene Name: prokineticin 1
  Uniprot ID: P58294
  ENST ID: ENST00000271331
  CDS Start-End: 18-335
cttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaggagggcagtcctctgtccagattggggtgggagcaagggacagggagcagggcaggggctgaaaggggcactgattcagaccagggaggcaactacacaccaacctgctggctttagaataaaagcaccaactgaa

SEQ ID NO: 169299 - DNA, 1549 bp, Homo sapiens
  Payload ID: 13324
  Gene Symbol: PROK2
  Gene Name: prokineticin 2
  Uniprot ID: Q9HC23
  ENST ID: ENST00000353065
  CDS Start-End: 155-481
gccggcgtgagtcacggcggggctagcctttataacggcccggaggctcgcgggagccgccgcgcccgtccgcccgccgctccgcgctccacccagcgcacccgggccccgcgcccccaactgcctccggcggccgcccagtcccgagggcgccatgaggagcctgtgctgcgccccactcctgctcctcttgctgctgccgccgctgctgctcacgccccgcgctggggacgccgccgtgatcaccggggcttgtgacaaggactcccaatgtggtggaggcatgtgctgtgctgtcagtatctgggtcaagagcataaggatttgcacacctatgggcaaactgggagacagctgccatccactgactcgtaaagttccattttttgggcggaggatgcatcacacttgcccatgtctgccaggcttggcctgtttacggacttcatttaaccgatttatttgtttagcccaaaagtaatcgctctggagtagaaaccaaatgtgaatagccacatcttacctgtaaagtcttacttgtgattgtgccaaacaaaaaatgtgccagaaagaaatgctcttgcttcctcaactttccaagtaacatttttatctttgatttgtaaatgatttttttttttttttatcgaaagagaattttacttttggatagaaatatgaagtgtaaggcattatggaactggttcttatttccctgtttgtgttttggtttgatttggcttttttcttaaatgtcaaaaacgtacccattttcacaaaaatgaggaaaataagaatttgatattttgttagaaaaacttttttttttttttctcaccaccccaagccccatttgtgccctgccacacaaatacacctacagcttttggtcccttgcctcttccacctcaaagaatttcaaggctcttaccttactttatttttgtccatttctcttccctcctcttgcattttaaagtggagggtttgtctctttgagtttgatggcagaatcactgatgggaatccagctttttgctggcatttaaatagtgaaaagagtgtatatgtgaacttgacactccaaactcctgtcatggcacggaagctaggagtgctgctggacccttcctaaacctgtcactcaagaggacttcagctctgctgttgggctggtgtgtggacagaaggaatggaaagccaaattaatttagtccagatttctaggtttgggtttttctaaaaataaaagattacatttacttcttttactttttataaagttttttttccttagtctcctacttagagatattctagaaaatgtcacttgaagaggaagtatttattttaatctggcacaacactaattaccatttttaaagcagtattaagttgtaatttaaaccttgtttgtaactgaaaggtcgattgtaatggattgccgtttgtacctgtatcagtattgctgtgtaaaaattctgtatcagaataataacagtactgtatatcatttgatttattttaatattatatccttatttttgtc

SEQ ID NO: 169300 - DNA, 1022 bp, Homo sapiens
  Payload ID: 13324
  Gene Symbol: PROK2
  Gene Name: prokineticin 2
  Uniprot ID: Q9HC23
  ENST ID: ENST00000295619
  CDS Start-End: 10-399
gagggcgccatgaggagcctgtgctgcgccccactcctgctcctcttgctgctgccgccgctgctgctcacgccccgcgctggggacgccgccgtgatcaccggggcttgtgacaaggactcccaatgtggtggaggcatgtgctgtgctgtcagtatctgggtcaagagcataaggatttgcacacctatgggcaaactgggagacagctgccatccactgactcgtaaaaacaattttggaaatggaaggcaggaaagaagaaagaggaagagaagcaaaaggaaaaaggaggttccattttttgggcggaggatgcatcacacttgcccatgtctgccaggcttggcctgtttacggacttcatttaaccgatttatttgtttagcccaaaagtaatcgctctggagtagaaaccaaatgtgaatagccacatcttacctgtaaagtcttacttgtgattgtgccaaacaaaaaatgtgccagaaagaaatgctcttgcttcctcaactttccaagtaacatttttatctttgatttgtaaatgatttttttttttttttatcgaaagagaattttacttttggatagaaatatgaagtgtaaggcattatggaactggttcttatttccctgtttgtgttttggtttgatttggcttttttcttaaatgtcaaaaacgtacccattttcacaaaaatgaggaaaataagaatttgatattttgttagaaaaacttttttttttttttctcaccaccccaagccccatttgtgccctgccacacaaatacacctacagcttttggtcccttgcctcttccacctcaaagaatttcaaggctcttaccttactttatttttgtccatttctcttccctcctcttgcattttaaagtggagggtttgtctctttgagtttgatggcagaatcactgatgggaatccagctttttgctggcatttaaatagtgaaaagagtgtatatgtgaacttgacactccaaactcctgtcatggcacg

SEQ ID NO: 169301 - DNA, 4273 bp, Homo sapiens
  Payload ID: 13325
  Gene Symbol: PROKR1
  Gene Name: prokineticin receptor 1
  Uniprot ID: Q8TCW9
  ENST ID: ENST00000303786
  CDS Start-End: 421-1602
acgcctcgccaagagcccgcacctcggcgcctcacggccaccggaggcggggacagggagtccggcgcgggccgggtcgggggatctgcagcggcggcgcgaaggtaactcccccgccagagccgggaaagagccccgagcagaggaggaagggagcggggacctgcccttcgcctgccggcttctggaagaagcgtctcctgatccggccccggaataagaaacccggaccttgcctgccgggctccgcgatgccgcaggtttagaatggagctcagataccataccccaaagatgctggcagagacattctgactcattaagggagagctggctgatagcagagaggggtgacatcagccttgcagacattgccctggggaattctgagcagtgttgctcacagcaccacctggccagatggagaccaccatggggttcatggatgacaatgccaccaacacttccaccagcttcctttctgtgctcaaccctcatggagcccatgccacttccttcccattcaacttcagctacagcgactatgatatgcctttggatgaagatgaggatgtgaccaattccaggacgttctttgctgccaagattgtcattgggatggccctggtgggcatcatgctggtctgcggcattggaaacttcatctttatcgctgccctggtccgctacaagaaactgcgcaacctcaccaacctgctcatcgccaacctggccatctctgacttcctggtggccattgtctgctgcccctttgagatggactactatgtggtgcgccagctctcctgggagcacggccacgtcctgtgcacctctgtcaactacctgcgcactgtctctctctatgtctccaccaatgccctgctggccatcgccattgacaggtatctggctattgtccatccgctgagaccacggatgaagtgccaaacagccactggcctgattgccttggtgtggacggtgtccatcctgatcgccatcccttccgcctacttcaccaccgagacggtcctcgtcattgtcaagagccaggaaaagatcttctgcggccagatctggcctgtggaccagcagctctactacaagtcctacttcctctttatctttggcatagaattcgtgggccccgtggtcaccatgaccctgtgctatgccaggatctcccgggagctctggttcaaggcggtccctggattccagacagagcagatccgcaagaggctgcgctgccgcaggaagacggtcctggtgctcatgtgcatcctcaccgcctacgtgctatgctgggcgcccttctacggcttcaccatcgtgcgcgacttcttccccaccgtgtttgtgaaggagaagcactacctcactgccttctacatcgtcgagtgcatcgccatgagcaacagcatgatcaacactctgtgcttcgtgaccgtcaagaacgacaccgtcaagtacttcaaaaagatcatgttgctccactggaaggcttcttacaatggcggtaagtccagtgcagacctggacctcaagacaattgggatgcctgccaccgaagaggtggactgcatcagactaaaataaccccctggactttgcaaagtttaaacacaaagcagggtcctgtggacactgactagtgtgcttggatgcacatcaacctggaactttttgtttgctgcagagggtaaagtaaatggaccactctgtgagcaatgttttcaaggagctcagagtttctaaaatgcatgtgaccagacactatcaacagtggcatttgctgaatgtctaatttacacgccagtaggtactggtaaaacctatatatgttgatgacatttagttggcaaaatgaaattggaattaaaccaaggaaaatgtggtggtgtagatagaaataagggagtttccacaaaagaactggagtaggtatctaggattgcagtacatgtgttcgtagtgtgagagtatctctgggactattcttgcactggacttcatgcctaacatttgcaaggctggagcaagaatacgaaagggactctaggctccttctgtagcccttatcctctcatctttcatggcgaggggccttgcatgcatgtgcacggacatcccagtattcatggccaagttctgtgcaaactcttcctcccacactgctctatggccaccctcaggcccagggctctgcacataggtggtaaggctcttcatcagaaggactggcttggcgaagaagacacatagaccctggatgccatttggacagggaattatggggttctgggtacctggagtaagtccagagggggaagcctggattcagggtaagcatgtcccctggctccatggactttttgccttcagtgagaagggagatgcaagtggaggagactcagaacgggaaggcaaaactggaagcatgcagggctcaatgcagctcaggtgtggcaggggctcaggctctccaggtatacagatgataccgttcccacctgttatttcatttggaccaattaggcttccccttaagtccttcccttccctctcacgcctccatgcttgtgaagcatagaatctttgaaaatggacacaatacctcctggatgtggccttcattcatttttctgttttcaccagctctcaaatgtgagtgatgaagagttccctcctaaccagacagcatggtaaggtatcctcatcgatatgatttgagggcaagatatccttattactggcacctgaatcccatcctagtctttgttcctttggattaagacttgctttgcttctaaaataggggtcctcttaggagggataagccacacgtttctagtcctcagcgtgaatgaagtcatgtgatccagtggcaggggatgcaggtcagatgcatcttccagaagtctgggcacccaggaaagaaggggacacacagataggtagtgtcagaccaaacaatgagcttcagtgaccccataggttgttgaagactcatcccactttctaacctgcctcctttgtttgatgttttgagttttggagtttggtattttggagttggaagatctgagagccagacttgactctgtcaactgtgtagccctgggcaaagcctctccgaggggacaaaggtaacacctttgtccttctgtggtaccttctgtgatacctgtgataccttctgactgagtggctatgagaagccaatgagacaatacgtgggagatgccttcaaccacacaagttatcaaaaggatgggctaggaactacgtgtagtgcgcctggacaagaaaaacctcttactttggcttgtgtatccagaaacctggccgtctccacttttatttttctttgtgtaaattattcctttgtgcttcataacagtgctgtatgcattatgtgcctaatgacatggttgtgcaaacaaggtcatgagatttgctggtagacgcataaaggaaagggtggctgagtctccggttagaagatgagtttaggggtttggatactccagaatcggagtatctttgtgatactagaagtgctgatcatcttcccatgactgttcccagccagcatgaatctgggcaatggaatagttgtttctcagtctgtttttattctcacgagtgtgtaggctacagcgtggacttgtctttttcttatttaactctagagcagcgcacttacaaggttatttaagtggcacctgtatgacatgttcccctccaaatatagtcaactccttattttgggcagcaaagtttattttgtatagttactttatttccctgaaagacacattacaaaaacctatttatttcttcccatttatcacccagtagacttaccctacaatttaatcagaatgctcttggagagtaaaattaattaaaatattagcctaaatcaaaaatgcattggagggccatttttattttttatataagatcatatattgcattctaaaatctggaaggttagcttttgtattaaaaagttaaaaatgatacaatttattgtcattatgttcaccgctttcattaagaatgctaaacaagagttgattgtattaaacaggagctttttatatgcggcaaccaaagcccactctgcttttcagcctaaaatgtatcaatttttcactcaactatctgtgttacttccaaatattagtgtctgcttgtaattttgtagtgaatgagggtgttgtgttgttatcaagtgaaatgaaaatacttggatatacag

SEQ ID NO: 169302 - DNA, 1155 bp, Homo sapiens
  Payload ID: 13326
  Gene Symbol: PROKR2
  Gene Name: prokineticin receptor 2
  Uniprot ID: Q8NFJ6
  ENST ID: ENST00000217270
  CDS Start-End: 1-1155
atggcagcccagaatggaaacaccagtttcacacccaactttaatccaccccaagaccatgcctcctccctctcctttaacttcagttatggtgattatgacctccctatggatgaggatgaggacatgaccaagacccggaccttcttcgcagccaagatcgtcattggcattgcactggcaggcatcatgctggtctgcggcatcggtaactttgtctttatcgctgccctcacccgctataagaagttgcgcaacctcaccaatctgctcattgccaacctggccatctccgacttcctggtggccatcatctgctgccccttcgagatggactactacgtggtacggcagctctcctgggagcatggccacgtgctctgtgcctccgtcaactacctgcgcaccgtctccctctacgtctccaccaatgccttgctggccattgccattgacagatatctcgccatcgttcaccccttgaaaccacggatgaattatcaaacggcctccttcctgatcgccttggtctggatggtgtccattctcattgccatcccatcggcttactttgcaacagaaacggtcctctttattgtcaagagccaggagaagatcttctgtggccagatctggcctgtggatcagcagctctactacaagtcctacttcctcttcatctttggtgtcgagttcgtgggccctgtggtcaccatgaccctgtgctatgccaggatctcccgggagctctggttcaaggcagtccctgggttccagacggagcagattcgcaagcggctgcgctgccgcaggaagacggtcctggtgctcatgtgcattctcacggcctatgtgctgtgctgggcacccttctacggtttcaccatcgttcgtgacttcttccccactgtgttcgtgaaggaaaagcactacctcactgccttctacgtggtcgagtgcatcgccatgagcaacagcatgatcaacaccgtgtgcttcgtgacggtcaagaacaacaccatgaagtacttcaagaagatgatgctgctgcactggcgtccctcccagcgggggagcaagtccagtgctgaccttgacctcagaaccaacggggtgcccaccacagaagaggtggactgtatcaggctgaagtga

SEQ ID NO: 169303 - DNA, 1354 bp, Homo sapiens
  Payload ID: 13327
  Gene Symbol: PRL
  Gene Name: prolactin
  Uniprot ID: P01236
  ENST ID: ENST00000306482
  CDS Start-End: 520-1203
atccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaatc

SEQ ID NO: 169304 - DNA, 1268 bp, Homo sapiens
  Payload ID: 13327
  Gene Symbol: PRL
  Gene Name: prolactin
  ENST ID: ENST00000615510
  CDS Start-End: 520-1110
atccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaatctaaaatg

SEQ ID NO: 169305 - DNA, 1364 bp, Homo sapiens
  Payload ID: 13327
  Gene Symbol: PRL
  Gene Name: prolactin
  ENST ID: ENST00000617911
  CDS Start-End: 520-1206
atccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaagcagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaatctaaaatg

SEQ ID NO: 169306 - DNA, 1679 bp, Homo sapiens
  Payload ID: 13328
  Gene Symbol: PRLR
  Gene Name: prolactin receptor
  Uniprot ID: P16471
  ENST ID: ENST00000231423
  CDS Start-End: 18-1148
aagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatcttaaaaacatggttctaac

SEQ ID NO: 169307 - DNA, 1297 bp, Homo sapiens
  Payload ID: 13328
  Gene Symbol: PRLR
  Gene Name: prolactin receptor
  Uniprot ID: P16471
  ENST ID: ENST00000310101
  CDS Start-End: 1-1050
atgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactga

SEQ ID NO: 169308 - DNA, 1339 bp, Homo sapiens
  Payload ID: 13328
  Gene Symbol: PRLR
  Gene Name: prolactin receptor
  Uniprot ID: P16471
  ENST ID: ENST00000348262
  CDS Start-End: 18-824
aagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatctta

SEQ ID NO: 169309 - DNA, 1206 bp, Homo sapiens
  Payload ID: 13328
  Gene Symbol: PRLR
  Gene Name: prolactin receptor
  ENST ID: ENST00000397391
  CDS Start-End: 18-122
aagagaaggcagccaacatgaaggaaaatgtggcatctgcaaccgttttcactctgctactttttctcaacacctgccttctgaatgagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatctta

SEQ ID NO: 169310 - DNA, 581 bp, Homo sapiens
  Payload ID: 13328
  Gene Symbol: PRLR
  Gene Name: prolactin receptor
  ENST ID: ENST00000515839
  CDS Start-End: 479-581
acagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaagttgtaaaaggatgactgcgtagagccacagcattctccttgtcagtgtaggaaatgcagaggaggatttacctccggcacttgcctctaagacacctaataaagatgaggaaggctccagcctgaagcgtgggtgaggtgtccagctgcccaaaggcgacagctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatcttta

SEQ ID NO: 169311 - DNA, 568 bp, Homo sapiens
  Payload ID: 13328
  Gene Symbol: PRLR
  Gene Name: prolactin receptor
  ENST ID: ENST00000503330
  CDS Start-End: 261-568
agcaaaggtgaggcagctgtgtctccctctggctgccttttctcccctcctctctcaccagaagccaacgcgtacacgctgagtggagaggccgcgaggacaagacagtgggacatgcgtgtgctggggaagtcgagaagcaggacaggaggcagctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggt

SEQ ID NO: 169312 - DNA, 1566 bp, Homo sapiens
  Payload ID: 13328
  Gene Symbol: PRLR
  Gene Name: prolactin receptor
  Uniprot ID: P16471
  ENST ID: ENST00000511486
  CDS Start-End: 1-1566
atgaaggaaaatgtggcatctgcaaccgttttcactctgctactttttctcaacacctgccttctgaatgttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactga

SEQ ID NO: 169313 - DNA, 583 bp, Homo sapiens
  Payload ID: 13328
  Gene Symbol: PRLR
  Gene Name: prolactin receptor
  ENST ID: ENST00000504500
  CDS Start-End: 398-583
attttaccgaccgttcgcgaaacagctttccacacaatggagcttcatgtcctcgtgcaggaagtactcatcgactgatgtggcagactttgctccctggcaaaagtcttacggataccaagtcccatgcctgccagcttgcacctgttaagtcatgtgatacttaggaaatgtacacatcaccccagtgcagaggcctttatccacttcccttcattttgcctggattgttgctgtgagtgagaaataaatgacatgaaatgatcatgtatatcactgtcttcagaggatgctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactg

SEQ ID NO: 169314 - DNA, 1440 bp, Homo sapiens
  Payload ID: 13328
  Gene Symbol: PRLR
  Gene Name: prolactin receptor
  Uniprot ID: P16471
  ENST ID: ENST00000514088
  CDS Start-End: 106-912
ctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatcttaaaaacatggttct

SEQ ID NO: 169315 - DNA, 588 bp, Homo sapiens
  Payload ID: 13328
  Gene Symbol: PRLR
  Gene Name: prolactin receptor
  ENST ID: ENST00000514206
  CDS Start-End: 228-588
cttattcctcctgctttgctgaaaccacagctgccttgaatcgagccattttgattctgccgcaaatgagctgtaaaccaaatcaagccacatcaaacaaatccaaccaccatcaaaagcaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacg

SEQ ID NO: 169316 - DNA, 1525 bp, Homo sapiens
  Payload ID: 13328
  Gene Symbol: PRLR
  Gene Name: prolactin receptor
  Uniprot ID: P16471
  ENST ID: ENST00000513753
  CDS Start-End: 18-884
aagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggaggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatcttaaaaacatggttctaac

SEQ ID NO: 169317 - DNA, 1610 bp, Homo sapiens
  Payload ID: 13328
  Gene Symbol: PRLR
  Gene Name: prolactin receptor
  Uniprot ID: P16471
  ENST ID: ENST00000509140
  CDS Start-End: 106-972
ctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggaggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatcttaaaaacatggttct

SEQ ID NO: 169318 - DNA, 579 bp, Homo sapiens
  Payload ID: 13328
  Gene Symbol: PRLR
  Gene Name: prolactin receptor
  ENST ID: ENST00000509839
  CDS Start-End: 246-579
agtccttggagtgaactgggagacaaggaggctgctttggcatggagctgagaacatctctagatcgcactggaaggcagagagaggccagacagggaactctgaagagctgccacagcctgtgccagggtgacatcaggctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagca

SEQ ID NO: 169319 - DNA, 1934 bp, Homo sapiens
  Payload ID: 13328
  Gene Symbol: PRLR
  Gene Name: prolactin receptor
  ENST ID: ENST00000508107
  CDS Start-End: 248-349
gctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatgatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggt

SEQ ID NO: 169320 - DNA, 1764 bp, Homo sapiens
  Payload ID: 13328
  Gene Symbol: PRLR
  Gene Name: prolactin receptor
  Uniprot ID: P16471
  ENST ID: ENST00000542609
  CDS Start-End: 106-1236
ctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatcttaaaaacatggttct

SEQ ID NO: 169321 - DNA, 1376 bp, Homo sapiens
  Payload ID: 13328
  Gene Symbol: PRLR
  Gene Name: prolactin receptor
  ENST ID: ENST00000618625
  CDS Start-End: 18-122
aagagaaggcagccaacatgaaggaaaatgtggcatctgcaaccgttttcactctgctactttttctcaacacctgccttctgaatgagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggaggtgaccccttgatgttgggtgcctctcattacaaaaatctcaaatcttacagaccaagaaaaatctcaagtcaaggaagacttgcggtgttcacaaaggcaacattgaccacagtccagtagagctgaagagcatataccagaattcaggaactcaacattttctcccctctgtccaaccacaggacagactgtgcaccccagggagatgctgtgtgtccactggcctcactgacttggattactcctgcagcacgtgaccagccagctcatatgatcactccctactgcccccaaagcagaattgactgggagctggaaacccacacaaaaagggacaattatattgaatgtaacatactccctctgcttacctagtgccttcacctcctatgggcatttggagtaaaaggttgttatgcaggtgtttgtgaaggatgtggccaagtcagttgtctcccttacagggtgacccaagattaatgatatctacccatccccagtccctcgaccccctagttgcaatcagctttgtcactgtcccccttaggcactgccatgtaaagcacgtggtcccccattctgaagcagtgggaaacctagaagagatgtactcttcgcaacctggttggatctta

SEQ ID NO: 169322 - DNA, 11063 bp, Homo sapiens
  Payload ID: 13328
  Gene Symbol: PRLR
  Gene Name: prolactin receptor
  Uniprot ID: P16471
  ENST ID: ENST00000620785
  CDS Start-End: 106-1671
ctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatgttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttcccagtacagctgtttatgtattcagtgggtacagtattttctgctgcaaggttataatgtgtatttacagtacatagtagtatataaagttcccgtttgtggagtaaaatgccataccaacccaaagcccactgtgaaatatgaagtgaatgacaaaattcagttttcaacgcaatatagtatagtttatctgattcttttgatctccaggacactttaaacaactgctaccaccaccaccaacctagggatttaggattctccacagaccagaaattatttctcctttgagtttcaggctcctctgggactcctgttcatcaatgggtgaatcttcctaaagctaccataaaaagggagggcgacgatttctaacagctgtttaaaagagagaggttttgcttttgtgagaaatcttgggccacaaaaaaattttaagcaaagccaggagttagtgtctctctgaagtaaattcaattgcaaaatcttggcagaggcagaaatggctcatatcagaagtgtccaaataaaagttctgggaaactaggtatttgcttcccagagcaatgggaatagctccaaaggtcagagtaaggtaatgagaatctcccggtcaattccagtgccaggcttcctgaaagaagtcaaagcttggatcctcattttaaagggcgcatccatgactcatctagcagcccctctctatttttcccttcacttgatggtaaatccattctatatgtccatttactagctggacatagagaacttgagctcacctctgggagttaaatattccaccccaactatcccatattgatagcaactggactcagaggtccccctcctgtttgaaagtgaacacattgccaatgttttgagaatggcaaaagcaatagatacgaagctccatttttctaatatataaacaatatcatgtgagtaagggaagcgtgtgggaaagttgtccaagctcattcagtcccctaaatcctcgatactttaactgtctgagaaccaactgcataggcatcacctgggcagtgtttgaaaattccatttgcagaatcttaagcatcagaatctgcattttactaagatccccaaatgattcaattgcacactgaagtttgagaagcattgttctagacaaccatttccactaaaggttattttagttcatagtaacaatcctcttttggaaaggacagatcaagtctgtttgacttgcaatgaacaacactgcatgtaagcaggcaaaaaaagaaacatatcagtagtttaagattcacattatgctgaatcttatatgaattcacataaaagaatgacctgcaaaactacgcacaacttctgaaaggccaaggaatataatctaccttgagagacattaaccaaagacagtcaccctcaaagccaatgcagactaaatctttcctaacatagtctattctctaagaatagagaagatatgtatcagtcactcttatagtctgaaaacctaaacataaaagtaatctgcttttgacatataattttgtataatacgtatgaaaaaatgtgacagctaaggacttgaattaaatccctaaaaaacaattagccactcattaggccaagactttaattctatgatcaattagcactgtttatctgaattaagcttttttgtggtctaacaaaaagtttttttgtggtctatcaaggagacagctgttcaaatggaaggatacatgtggggcaggggggcggtgaagagacctagattctggtcctaactgctttgccttggagagattaattcccccctctaagcctcagtttcctctgaagatgttggaccagataacctctaaggtcctttgaaactgactccttgattccatgactcactgaatatttttctgcaaagataatcccaaccaatgccttctatcctaatctaacaaaaaattgctcttcatcatagaaatacaaagtaatcttcagtgatgtgctctttatactttgctttttaaaccgtccattccagttggtcttaatatattgcacaagtattttataagtgaaatgtgtacagaatcatattctaagattatgtgcaaatatatgtgtagaaagaggcatttaaaaaaagaggcaggagattgagaagagacatattgaatgaggcactaatctttagaaaaatgatcttttactgaatcaagccatgctcattccttgctgaatccaacagccccaaatctcttttcttatatttggctgttaatttttttccttgcaccatcctagattgttaacaaccattgcacagttggctcatgtatccttacactctgagttataataagttgtatttttataaacaaatacctaaatattcaagttttaaggcgcatggaaactgaatctaggcaacgggtgatttgtgtagcttacaacctgaacagcaagatgttccaattcattctaacagatgtgtataagcacaagttatatcagctgtgtcagatatttaacagatcctacatttattagctatataacagactctacattttcctaagtgcctaagaccaatcctggtagtcacttaagtacaaaagactcactttaactggcttggtctgaaggggtcaatcctttactgcctgtacaagatctgggcagttttgctctgtgtcttgtgatgacccagctgaatgtgaaaagcctatgagttattgagcaaccagaggtccctgcattccaagttgcagtttagctctggggaaactctggctttctctttcctcaagtgtccaccactgcccatcatttgcagaaagacttggccctgcctttagcaacttccctatctccttagagtagacaagaaagaaacagatttgtgcacattttacaaagtgccttcctctatttttttttaaagttttcattttgcaaggaaaaatgtattgattagaaagtaacatttgccttatagggattatatatatatatagatatagatatagatatgtatgaatggagagatgagaagaagccagaaagggcacaacaaaatggtctaagggccaaccagcaatgttcagtgaatgtttacgtattgtttaattgaatcaacacagagctgttgtgaatagtgtgacttactttgcctgataagaaattgaggctggctgtgatttggggataaacctgccaccctgtgatttgagactctccataccaaaacttattgatacatttttgaatgtcattggcttacatgcctaaacctgaagagaacaatgcatgcacattggaactttgtacacaaacagaaaaatataaatgactttgaattaccatcccaagcattgctaacgtagatgtgccattgacgaaagtctcatgtgttcttgagtgaacaaatttccttttcttcctttttggctcaagcacaataatgctgtcactgagacagtgactgagcactcaatgtccaagactaaatcacatcaccacgactaagtaggcactatgtcctgggatgagtcttttaaactctggccatcaggttccttacttgttaaataagtaggttggcctaaaaggtttctaagacctctcatgatctaggtaaaatccagggtttcaggtcagtgtccctggtgcagtgcaagaaagccttgctgacacacccttggcctgaagcagtgagcacatgagattgtgtgacaacgcttcagagaaaaacagagatctgttcctccaactcagattgatttaacatccttgcttctccttttccttcctggctttacatatttgtagggtttttactccttctccagagcctactattttcctaagagttagtagcaaccataggatccacaagaaatgaaattattcatcaacaatgactttggcactgcaaaagactgagtcaaaggttaaatcagtcacacagatatccaaggccaagttgaagatcacaagtatatcccatttagagatttgcatacttagagattaagcccatgttcattaattatttagttaattcaaaagccattaataaatccatgcccagcctacgcaacatagtaagacccagtctctacaaaaattttaaaaattagccagccatggtgacacgtacctgtagtcctagacacttgggaaggtgaagccagaggattgcttgagcccaggaggtcgaggctgcagtgaaccgtgattgtgtcactgcactccagcctgggtgagagagcaagaccttgtctcaataaataaacccaagttacttcgatgactagatactggaggtctgaaggagaagctttaaaaatacagattgattgcttcagagaaatcctatttataattatgatctgaacttattctatgattagcaaatatatcatctgaaaataaaacaggagttctctccccagacttttgtttttcaggatggtgagttttggtctgggaccctcatggcacccattttgataaaaggaaaaagatagtaaaacaggaaataggaagtttccagagatttgggcatctcaggattccatgaaatgctgagactaacccactaaatccaaattttattggctatggtaaatctaaatctgttcagtgttctgaacagattttatgagtttatgtctaagagtttatgtctaagagaggtacataattcacaaacactatcatgctggcagctgttttgtccacatcaattcccttgatttaatgctctgatttcaatttagaaagtactgagacatgtaaagtctcaaaataggaaaaacctatcctgtttataaggtgtggtcaataaatagaccacagataatcttagtctattaattaactctcagatcatcttagactattaattaacattctgcttgctgctgattaaaaagaaaaaaaccctaaaaccttcagcaactgaagtagtaatataaaaaataacctttaatagttatggtcaaattacgcttcacttggataaacctcaaaatgtagtctgagtttttttgtgcacacttcacaaatcctgggggaaaaatcttttttccacgttatctgaaaaactatatggcgaagataccgctgaaaaataatttgttttatgaaattcctgaaaagctaattttgaattttttaaagtaactacctcccttttgtgtcctaatgtccttccttcaaagctgcttatagtttagaaatgaaagatgtcatgtctcatgctttgactggttttcggtggcatatttgatgtatttgccaagtggcattactgactttacagtaactgttacattattttgtactatattgctttatgtggttcaaaaatagtatatgccatattgaaatatgtaatcctcatgttgtgaaactcatcatgtaatacaaatgaaaatcattacttaataacttacaatttatccatatgtagtttcaatatgattgtgtctatgactgtaaaacaaaactgaaaaaatatgtaatgtatttctgttgaaagcgtgaatgtactaattttttcctaatctttgtctagaagaaagattctatgtcattcattgtacagctgctctggggtgttacacatttaaagtacaatccaacagttgtttgaaagtcagcctctcggctttgtttcatgtgactgctgacacttctcaagtgttctttgcataatgaggctggattttgtgcttcatcgttcattttaaacaattgaaaagtctcatgtggaaaccaaagcaatctagaaccagcctgttgggtgactgtgtcttctgtaaagccatattgaagtgaagttatacataatagcataaggttccacattttcaaagctaccactacctctgcttttcctctttccctagaaaatgccaagcaaaattccccaacactaagtgagaaattagaagtaattgttttataattaagttgctgggttttttttttaacaccttctaattcatcactttgtagggttatgcaagagtttctgaataaccattcttacatgtttatattttataaaaaccggctgcaagaaagattcagaaagaatacttagtaagtcatcatatgaaaaaccaacaaaaccatagagtgcagattttttcctaactataagtcacctcatagttgtccaaagccatgataatgatatctcttacaaattgacttctgtaacccccctagaaataacccttttccttatttgattttagtcatcaaacatagtatgatatgggaaaagtcagccatttaccagaaattatcttattttgattttaaaaactcatttctatatgtagttattgtaatgtctatttttttagacttaaagatttatagaagactatagttatctgatttgttattttgcatttttcattctgtaaatctttgcttatggcacattgtgctctctgttttccatggttttattcatttatctcctcctattttgaggggacaacatgggtagttaaatctttgtcaatagtattggagataacactaactgctattatcataacatcttcatttttactgcatgccaaaaccaatgcctgccaaacaaaatcttagacatcccaatataatatgttagttatatttctattcacatcattattgaaaatacccagctcagtgcctggcttaataaatgtttaattcccttacctactcttgctctatttttttatttgaaatggagatgagcaaaataacacattcatggctgaagcaattttttggacatttcttgttaccaaaagatctataatcaggacattgtttatgtaagttggacaaaaaaaattcttcccctttatgtccacccttcctatgattgcaagacaaaatttccctcctttacctcatccctataacatgggaggctgagaaaaatgaggggagatggaaccagatacaaggagatccaataagagaagcttatttaaatattgtgaaataaaggaagaaccaaagcatttttttaagtggggaatccttttgaacagttattatttatccatattattaacaacatcttttctgacaaaatccatcagatgaagtgtaaatggataatcttttaatggatctaaacctagaaagtttcacttactgttcatgtccgtgttccagaattgtgaaatggtgtgtggttttgctttccaagttcttctctgcctcctcttaattctctaattccatgtcttacagaagaatgagaaatttctttcttacttgagtatcatgctctaaaaaacttggcttcagtcacagaaacgctggctctcctgtgcttatattgaagccaactgcctttaattcttgggccctcttatatttttaaggtgcaaaatttgaagtctcagtcaccagacacaggttctatacaattaatgatgagctggagaagtaatatgtagctaatttttcaaaagcattgaatatactttccggaaagaaaacagaaattaaatattgccacatcttgccagaatcccatctgacaccttaactttgtcaggtttcctacaacttgctaatcaagttttatacattctaaatctccccagtttctttggggctggaagatgcaacttccatttaatagaaactttgaaatcttggggtaagggagcagtggggggactagggagaaggataagaaatagaattattgaaaagcccccaccagggaccttcctggccagaatatgcagagtaattcctgctggcttcacctttgaaagtccctcgaaactatgcagatgaaactgagtctgtttttgatattgtcagatgtattctaccttggaagtcccaacacctaaactggaattcttgtatttacatctcctccactgtcccccacaccacccctcaattcctgctgcccctgctaatgttaagcatttttctcttgttatcatcaggttcacattaaaaacagatacttacaaactgacttgaagcacagatacttttacgaatgtgataaaatattttcttaagaaaaggaaagaggatgtgggtcaaataaaacaccgcatggatgttgattggtgaatactggtgtaagaaaagggagctcaggaatttttattactgtatttgtaaatgagtttgaaggaatttgtaaatgccactggtacatttttaaggtgacacatttgctccttataaagttattaaaaattacagggtaagcttaaatgacgtttgccagtagttttactttatataatcaatattgatattgttgctgaactatgtaactttatgatgcatttttcagtcccttttcagagcaaatgcttttgcaatggtagtaatgtttagtttaaattgacttaataaattattacctgagcaatggtt

SEQ ID NO: 169323 - DNA, 11688 bp, Homo sapiens
  Payload ID: 13328
  Gene Symbol: PRLR
  Gene Name: prolactin receptor
  Uniprot ID: P16471
  ENST ID: ENST00000618457
  CDS Start-End: 428-2296
atgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttcccagtacagctgtttatgtattcagtgggtacagtattttctgctgcaaggttataatgtgtatttacagtacatagtagtatataaagttcccgtttgtggagtaaaatgccataccaacccaaagcccactgtgaaatatgaagtgaatgacaaaattcagttttcaacgcaatatagtatagtttatctgattcttttgatctccaggacactttaaacaactgctaccaccaccaccaacctagggatttaggattctccacagaccagaaattatttctcctttgagtttcaggctcctctgggactcctgttcatcaatgggtgaatcttcctaaagctaccataaaaagggagggcgacgatttctaacagctgtttaaaagagagaggttttgcttttgtgagaaatcttgggccacaaaaaaattttaagcaaagccaggagttagtgtctctctgaagtaaattcaattgcaaaatcttggcagaggcagaaatggctcatatcagaagtgtccaaataaaagttctgggaaactaggtatttgcttcccagagcaatgggaatagctccaaaggtcagagtaaggtaatgagaatctcccggtcaattccagtgccaggcttcctgaaagaagtcaaagcttggatcctcattttaaagggcgcatccatgactcatctagcagcccctctctatttttcccttcacttgatggtaaatccattctatatgtccatttactagctggacatagagaacttgagctcacctctgggagttaaatattccaccccaactatcccatattgatagcaactggactcagaggtccccctcctgtttgaaagtgaacacattgccaatgttttgagaatggcaaaagcaatagatacgaagctccatttttctaatatataaacaatatcatgtgagtaagggaagcgtgtgggaaagttgtccaagctcattcagtcccctaaatcctcgatactttaactgtctgagaaccaactgcataggcatcacctgggcagtgtttgaaaattccatttgcagaatcttaagcatcagaatctgcattttactaagatccccaaatgattcaattgcacactgaagtttgagaagcattgttctagacaaccatttccactaaaggttattttagttcatagtaacaatcctcttttggaaaggacagatcaagtctgtttgacttgcaatgaacaacactgcatgtaagcaggcaaaaaaagaaacatatcagtagtttaagattcacattatgctgaatcttatatgaattcacataaaagaatgacctgcaaaactacgcacaacttctgaaaggccaaggaatataatctaccttgagagacattaaccaaagacagtcaccctcaaagccaatgcagactaaatctttcctaacatagtctattctctaagaatagagaagatatgtatcagtcactcttatagtctgaaaacctaaacataaaagtaatctgcttttgacatataattttgtataatacgtatgaaaaaatgtgacagctaaggacttgaattaaatccctaaaaaacaattagccactcattaggccaagactttaattctatgatcaattagcactgtttatctgaattaagcttttttgtggtctaacaaaaagtttttttgtggtctatcaaggagacagctgttcaaatggaaggatacatgtggggcaggggggcggtgaagagacctagattctggtcctaactgctttgccttggagagattaattcccccctctaagcctcagtttcctctgaagatgttggaccagataacctctaaggtcctttgaaactgactccttgattccatgactcactgaatatttttctgcaaagataatcccaaccaatgccttctatcctaatctaacaaaaaattgctcttcatcatagaaatacaaagtaatcttcagtgatgtgctctttatactttgctttttaaaccgtccattccagttggtcttaatatattgcacaagtattttataagtgaaatgtgtacagaatcatattctaagattatgtgcaaatatatgtgtagaaagaggcatttaaaaaaagaggcaggagattgagaagagacatattgaatgaggcactaatctttagaaaaatgatcttttactgaatcaagccatgctcattccttgctgaatccaacagccccaaatctcttttcttatatttggctgttaatttttttccttgcaccatcctagattgttaacaaccattgcacagttggctcatgtatccttacactctgagttataataagttgtatttttataaacaaatacctaaatattcaagttttaaggcgcatggaaactgaatctaggcaacgggtgatttgtgtagcttacaacctgaacagcaagatgttccaattcattctaacagatgtgtataagcacaagttatatcagctgtgtcagatatttaacagatcctacatttattagctatataacagactctacattttcctaagtgcctaagaccaatcctggtagtcacttaagtacaaaagactcactttaactggcttggtctgaaggggtcaatcctttactgcctgtacaagatctgggcagttttgctctgtgtcttgtgatgacccagctgaatgtgaaaagcctatgagttattgagcaaccagaggtccctgcattccaagttgcagtttagctctggggaaactctggctttctctttcctcaagtgtccaccactgcccatcatttgcagaaagacttggccctgcctttagcaacttccctatctccttagagtagacaagaaagaaacagatttgtgcacattttacaaagtgccttcctctatttttttttaaagttttcattttgcaaggaaaaatgtattgattagaaagtaacatttgccttatagggattatatatatatatagatatagatatagatatgtatgaatggagagatgagaagaagccagaaagggcacaacaaaatggtctaagggccaaccagcaatgttcagtgaatgtttacgtattgtttaattgaatcaacacagagctgttgtgaatagtgtgacttactttgcctgataagaaattgaggctggctgtgatttggggataaacctgccaccctgtgatttgagactctccataccaaaacttattgatacatttttgaatgtcattggcttacatgcctaaacctgaagagaacaatgcatgcacattggaactttgtacacaaacagaaaaatataaatgactttgaattaccatcccaagcattgctaacgtagatgtgccattgacgaaagtctcatgtgttcttgagtgaacaaatttccttttcttcctttttggctcaagcacaataatgctgtcactgagacagtgactgagcactcaatgtccaagactaaatcacatcaccacgactaagtaggcactatgtcctgggatgagtcttttaaactctggccatcaggttccttacttgttaaataagtaggttggcctaaaaggtttctaagacctctcatgatctaggtaaaatccagggtttcaggtcagtgtccctggtgcagtgcaagaaagccttgctgacacacccttggcctgaagcagtgagcacatgagattgtgtgacaacgcttcagagaaaaacagagatctgttcctccaactcagattgatttaacatccttgcttctccttttccttcctggctttacatatttgtagggtttttactccttctccagagcctactattttcctaagagttagtagcaaccataggatccacaagaaatgaaattattcatcaacaatgactttggcactgcaaaagactgagtcaaaggttaaatcagtcacacagatatccaaggccaagttgaagatcacaagtatatcccatttagagatttgcatacttagagattaagcccatgttcattaattatttagttaattcaaaagccattaataaatccatgcccagcctacgcaacatagtaagacccagtctctacaaaaattttaaaaattagccagccatggtgacacgtacctgtagtcctagacacttgggaaggtgaagccagaggattgcttgagcccaggaggtcgaggctgcagtgaaccgtgattgtgtcactgcactccagcctgggtgagagagcaagaccttgtctcaataaataaacccaagttacttcgatgactagatactggaggtctgaaggagaagctttaaaaatacagattgattgcttcagagaaatcctatttataattatgatctgaacttattctatgattagcaaatatatcatctgaaaataaaacaggagttctctccccagacttttgtttttcaggatggtgagttttggtctgggaccctcatggcacccattttgataaaaggaaaaagatagtaaaacaggaaataggaagtttccagagatttgggcatctcaggattccatgaaatgctgagactaacccactaaatccaaattttattggctatggtaaatctaaatctgttcagtgttctgaacagattttatgagtttatgtctaagagtttatgtctaagagaggtacataattcacaaacactatcatgctggcagctgttttgtccacatcaattcccttgatttaatgctctgatttcaatttagaaagtactgagacatgtaaagtctcaaaataggaaaaacctatcctgtttataaggtgtggtcaataaatagaccacagataatcttagtctattaattaactctcagatcatcttagactattaattaacattctgcttgctgctgattaaaaagaaaaaaaccctaaaaccttcagcaactgaagtagtaatataaaaaataacctttaatagttatggtcaaattacgcttcacttggataaacctcaaaatgtagtctgagtttttttgtgcacacttcacaaatcctgggggaaaaatcttttttccacgttatctgaaaaactatatggcgaagataccgctgaaaaataatttgttttatgaaattcctgaaaagctaattttgaattttttaaagtaactacctcccttttgtgtcctaatgtccttccttcaaagctgcttatagtttagaaatgaaagatgtcatgtctcatgctttgactggttttcggtggcatatttgatgtatttgccaagtggcattactgactttacagtaactgttacattattttgtactatattgctttatgtggttcaaaaatagtatatgccatattgaaatatgtaatcctcatgttgtgaaactcatcatgtaatacaaatgaaaatcattacttaataacttacaatttatccatatgtagtttcaatatgattgtgtctatgactgtaaaacaaaactgaaaaaatatgtaatgtatttctgttgaaagcgtgaatgtactaattttttcctaatctttgtctagaagaaagattctatgtcattcattgtacagctgctctggggtgttacacatttaaagtacaatccaacagttgtttgaaagtcagcctctcggctttgtttcatgtgactgctgacacttctcaagtgttctttgcataatgaggctggattttgtgcttcatcgttcattttaaacaattgaaaagtctcatgtggaaaccaaagcaatctagaaccagcctgttgggtgactgtgtcttctgtaaagccatattgaagtgaagttatacataatagcataaggttccacattttcaaagctaccactacctctgcttttcctctttccctagaaaatgccaagcaaaattccccaacactaagtgagaaattagaagtaattgttttataattaagttgctgggttttttttttaacaccttctaattcatcactttgtagggttatgcaagagtttctgaataaccattcttacatgtttatattttataaaaaccggctgcaagaaagattcagaaagaatacttagtaagtcatcatatgaaaaaccaacaaaaccatagagtgcagattttttcctaactataagtcacctcatagttgtccaaagccatgataatgatatctcttacaaattgacttctgtaacccccctagaaataacccttttccttatttgattttagtcatcaaacatagtatgatatgggaaaagtcagccatttaccagaaattatcttattttgattttaaaaactcatttctatatgtagttattgtaatgtctatttttttagacttaaagatttatagaagactatagttatctgatttgttattttgcatttttcattctgtaaatctttgcttatggcacattgtgctctctgttttccatggttttattcatttatctcctcctattttgaggggacaacatgggtagttaaatctttgtcaatagtattggagataacactaactgctattatcataacatcttcatttttactgcatgccaaaaccaatgcctgccaaacaaaatcttagacatcccaatataatatgttagttatatttctattcacatcattattgaaaatacccagctcagtgcctggcttaataaatgtttaattcccttacctactcttgctctatttttttatttgaaatggagatgagcaaaataacacattcatggctgaagcaattttttggacatttcttgttaccaaaagatctataatcaggacattgtttatgtaagttggacaaaaaaaattcttcccctttatgtccacccttcctatgattgcaagacaaaatttccctcctttacctcatccctataacatgggaggctgagaaaaatgaggggagatggaaccagatacaaggagatccaataagagaagcttatttaaatattgtgaaataaaggaagaaccaaagcatttttttaagtggggaatccttttgaacagttattatttatccatattattaacaacatcttttctgacaaaatccatcagatgaagtgtaaatggataatcttttaatggatctaaacctagaaagtttcacttactgttcatgtccgtgttccagaattgtgaaatggtgtgtggttttgctttccaagttcttctctgcctcctcttaattctctaattccatgtcttacagaagaatgagaaatttctttcttacttgagtatcatgctctaaaaaacttggcttcagtcacagaaacgctggctctcctgtgcttatattgaagccaactgcctttaattcttgggccctcttatatttttaaggtgcaaaatttgaagtctcagtcaccagacacaggttctatacaattaatgatgagctggagaagtaatatgtagctaatttttcaaaagcattgaatatactttccggaaagaaaacagaaattaaatattgccacatcttgccagaatcccatctgacaccttaactttgtcaggtttcctacaacttgctaatcaagttttatacattctaaatctccccagtttctttggggctggaagatgcaacttccatttaatagaaactttgaaatcttggggtaagggagcagtggggggactagggagaaggataagaaatagaattattgaaaagcccccaccagggaccttcctggccagaatatgcagagtaattcctgctggcttcacctttgaaagtccctcgaaactatgcagatgaaactgagtctgtttttgatattgtcagatgtattctaccttggaagtcccaacacctaaactggaattcttgtatttacatctcctccactgtcccccacaccacccctcaattcctgctgcccctgctaatgttaagcatttttctcttgttatcatcaggttcacattaaaaacagatacttacaaactgacttgaagcacagatacttttacgaatgtgataaaatattttcttaagaaaaggaaagaggatgtgggtcaaataaaacaccgcatggatgttgattggtgaatactggtgtaagaaaagggagctcaggaatttttattactgtatttgtaaatgagtttgaaggaatttgtaaatgccactggtacatttttaaggtgacacatttgctccttataaagttattaaaaattacagggtaagcttaaatgacgtttgccagtagttttactttatataatcaatattgatattgttgctgaactatgtaactttatgatgcatttttcagtcccttttcagagcaaatgcttttgcaatggtagtaatgtttagtttaaattgacttaataaattattacctgagcaatggtt

SEQ ID NO: 169324 - DNA, 1402 bp, Homo sapiens
  Payload ID: 13328
  Gene Symbol: PRLR
  Gene Name: prolactin receptor
  Uniprot ID: P16471
  ENST ID: ENST00000619676
  CDS Start-End: 106-1155
ctaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactga

SEQ ID NO: 169325 - DNA, 2166 bp, Homo sapiens
  Payload ID: 13329
  Gene Symbol: PREB
  Gene Name: prolactin regulatory element binding
  Uniprot ID: Q9HCU5
  ENST ID: ENST00000260643
  CDS Start-End: 255-1508
gcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 169326 - DNA, 1910 bp, Homo sapiens
  Payload ID: 13329
  Gene Symbol: PREB
  Gene Name: prolactin regulatory element binding
  ENST ID: ENST00000406567
  CDS Start-End: 192-1271
ggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaag

SEQ ID NO: 169327 - DNA, 351 bp, Homo sapiens
  Payload ID: 13329
  Gene Symbol: PREB
  Gene Name: prolactin regulatory element binding
  ENST ID: ENST00000441451
  CDS Start-End: 1-69
gtcgtctcctgcctcgatgtcaggtgtgagacattgctgccttggctagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctcc

SEQ ID NO: 169328 - DNA, 1105 bp, Homo sapiens
  Payload ID: 13329
  Gene Symbol: PREB
  Gene Name: prolactin regulatory element binding
  ENST ID: ENST00000456259
  CDS Start-End: 1-529
ccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacgggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatt

SEQ ID NO: 169329 - DNA, 615 bp, Homo sapiens
  Payload ID: 13329
  Gene Symbol: PREB
  Gene Name: prolactin regulatory element binding
  ENST ID: ENST00000430533
  CDS Start-End: 1-319
ccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctg

SEQ ID NO: 169330 - DNA, 2030 bp, Homo sapiens
  Payload ID: 13329
  Gene Symbol: PREB
  Gene Name: prolactin regulatory element binding
  ENST ID: ENST00000444452
  CDS Start-End: 195-347
cttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactga

SEQ ID NO: 169331 - DNA, 264 bp, Homo sapiens
  Payload ID: 13330
  Gene Symbol: PRLH
  Gene Name: prolactin releasing hormone
  Uniprot ID: P81277
  ENST ID: ENST00000165524
  CDS Start-End: 1-264
atgaaggtgctgagggcctggctcctgtgcctgctgatgctgggcctggccctgcggggagctgcaagtcgtacccatcggcactccatggagatccgcacccctgacatcaatcctgcctggtacgccagtcgcgggatcaggcctgtgggccgcttcggtcggaggagggcaaccctgggggacgtccccaagcctggcctgcgaccccggctgacctgcttccccctggaaggcggtgctatgtcgtcccaggatggctga

SEQ ID NO: 169332 - DNA, 5446 bp, Homo sapiens
  Payload ID: 13331
  Gene Symbol: PRLHR
  Gene Name: prolactin releasing hormone receptor
  Uniprot ID: P49683
  ENST ID: ENST00000239032
  CDS Start-End: 191-1303
gaggggaggcgctcccagtccctctaagaagctgctagcccactgggaaacatttggatccgttcagctcccgcggagaagcgagaccggatcaccgacgtgggcagaggactaccgagggccagcagaaattctgccccttcttcccgcgagtgctttcccgctctccaaaccccactcccaggtggccatggcctcatcgaccactcggggccccagggtttctgacttattttctgggctgccgccggcggtcacaactcccgccaaccagagcgcagaggcctcggcgggcaacgggtcggtggctggcgcggacgctccagccgtcacgcccttccagagcctgcagctggtgcatcagctgaaggggctgatcgtgctgctctacagcgtcgtggtggtcgtggggctggtgggcaactgcctgctggtgctggtgatcgcgcgggtgcgccggctgcacaacgtgacgaacttcctcatcggcaacctggccttgtccgacgtgctcatgtgcaccgcctgcgtgccgctcacgctggcctatgccttcgagccacgcggctgggtgttcggcggcggcctgtgccacctggtcttcttcctgcagccggtcaccgtctatgtgtcggtgttcacgctcaccaccatcgcagtggaccgctacgtcgtgctggtgcacccgctgaggcggcgcatctcgctgcgcctcagcgcctacgctgtgctggccatctgggcgctgtccgcggtgctggcgctgcccgccgccgtgcacacctatcacgtggagctcaagccgcacgacgtgcgcctctgcgaggagttctggggctcccaggagcgccagcgccagctctacgcctgggggctgctgctggtcacctacctgctccctctgctggtcatcctcctgtcttacgtccgggtgtcagtgaagctccgcaaccgcgtggtgccgggctgcgtgacccagagccaggccgactgggaccgcgctcggcgccggcgcaccttctgcttgctggtggtgatcgtggtggtgttcgccgtctgctggctgccgctgcacgtcttcaacctgctgcgggacctcgacccccacgccatcgacccttacgcctttgggctggtgcagctgctctgccactggctcgccatgagttcggcctgctacaaccccttcatctacgcctggctgcacgacagcttccgcgaggagctgcgcaaactgttggtcgcttggccccgcaagatagccccccatggccagaatatgaccgtcagcgtggtcatctgatgccacttagccaggccttggtcaaggagctccacttcaactggcctcctagggcaccactcgaggtcaatctggtgcttattctcagcaccagagctagctaagccaacatagggcaacatttccagcccagccctcttgtccggctgtctgtcttgtccttgtgtgtttgtaaaatgttaagcgggctttggtgagagtcttgctctttgcttgggggaggccaaagagagggaagaggatttcttatttcttctttatgcccttgaaggacaaacaaaactttttctccacgttcagaaaagtatttcagaaccacgattgccttcctggcgtcccctcctcctgctcgttggtgaaatgaacaatatgaatgggatttaaaaggaatgcattgggcttggtaaagattttcagtttgcctttagaaaaaggacccagctgagagtaccatgatattgcttagtccatttgaacccttgcattcctagaatttcaggtaaatatgtattaaaactctacatctaggatttcagcatttcctgagtaagacctttatatgccaaaagggtttcgttttaaaaccacttgagtttatagtacaaaaacacctacaagctccctttagaaaggtcttgctattgtttctcccctttcctccccaactactatttaaaaatgatgagacgaattagtcaatgaagagatagataaataaagaggaaaaggtccaattcacttaagaggtcattcaattgtacctaaggacagacatcctctgtgtatgtgtgtttgtgtatgtgtgtgtatgtgtgggtacacattcagtgtttgccacaaagtgggcactcaaatatttggttttctgaatactcaatgtaaactgtgtagcgtggcattctcctgcagtctctaattgctcacttgcaacagatcaacagctgtcatctgactgctcagcacctgctctgtagtgattcttggaacatgatcaacccagaaatcaaggaccggcagaagtttacttaaggacagaacagaagaataagctaccacccacatgatgtgtagatcaaacactaattacctccagggttaagggaaaaggtgaagactgtggagcatgataccaggctgataatcatcaccttaacctcctgtgagttctgtaaatgaggacaagtgccttgggacaaaggtctccacactgttggaaaagcaacttgggcagtgagggcaggagtcttgggaaatgatacataatatccagctgtcagatcagcctctgtgttcccagtaactcagtcaccatctgtagggttcaactactttcccagctcactgaacacaagaatcactgtttcacctcctcctgcttctcttattcagaaataagctcaattcattcattaaaatgtgccctaaaaggaaaggaaagagggatgatatgggaatgacaagggttcaatcctattacattcatgtcaacaaccatggtgggagtgggagtgatcacggttgggctggttggcataggaatctttagtagttacagggctagactttttgcacacagtaaagggtaggaaaggctggcttgggagaaaggaaaaggcaggcaaagatgggtatggaggttacctctggcaatggtgctaaatgaacttgagcttcatccgtggattggagaacaaagaacctgtgtgctaatagtgcaacccacccctgccccagataagctcatctcccaggcatcccgaggactggctcctgtgcttccagcagctatattacttgggaggctcagggccagacatttctcatttcctcagagagttcctttgatggtcatgtgtggagagtgtagatggtagaggggaaggagagggattatttggggagggatctgattcatcgtcggctctttgttggaaggtttgaatcactggttctcaaccctggctgctcctagaatcacctggggaacttttttttctttttgtaattgatgtctgggctctcctcccaagagtctagttgatttgagatggtgcctggacactagcattttccaaagcacttcaggggattttaatgtgcaaccaagattaagcaccttaagaattatcctttctagggctgggcatggtggcttacacctgtaatcccagcattttgggggaccgaggcaggcagatcacaaggtcaggagtttgagaccagcctggccaacgtgttgaaaccctgtctctacttaaaatacaaaaattagccaggcgtggtggcgcacgcctgtaatcccagctactcgggaggctgaggcaggagaattgcttgaacccagggaggcagaggttgcagtgagctgagattgtgccagtgtactccaacctgggtgacagaacaagactccatctcggggtggggggtgggggcgggaatcctctttctaatgaatctcagaaacatccgaatgaagctttagttgtacctgccaaaggtgttaataatttggagctgaatttgacggtgttacatgccatacttagagaatactcttttagtcttcaggcaataccagctcaatcacaaagaggcaaattattgaaatcagaatatatagggattcgttcaacagtttacttacatatttcttatgtatcagtccaatcaattcagaaggaatatcatcattcaaccttaggtcaattgtattataaagttacataccatggccaggtaccatggctcacatctataattccaaaactttgggagaccgaagagggagaattgcttgagcccaggagttcaagaccagcctgggaaatatggcaaaactccatctctacaaaaaatagccggacgtggtggtgcacacctgtggtcccagctacttgggacacaaaggcaggaggatcacttgagcctgggaggatcactgggctgcagtgagctatcattacaccactgcactccagtctcagtgacagagcaaaatctagtctcaaaaaaacaaaaaaaacaaaaacaacaaaaaacaacaaaaaacaaatttacataccatgaattattttaaatcctggttgtcagggtgttagaaaaagtgctccttgattagcttaagtttatatcaactatgaaaaacaagcatctccattaattactagaaaagctgccactggtttctgtcatgcctacaacttaagtttgaaacacttacatggactttataaagagcttaaagaggttggagaattagattgtgcttataaacatctttacatattatgaaaatcagcaacggaacagcaattaattcttacaacatctgaaatgtgttgtggactagtttataaatcaaaccgaatttcaaaaaaatcagaggtgagtcccagagagaactgcgtaggactgtaggtagaaaattttatttaataattcattttggttaatatcaagcatctaagatgtatacacagtcctcttcctgcaaggagtaatacaggcagtcaggctgggaactgagccaacttggtacttggcagcagcccttctcaaggctgatgggaggttctgtaatcctctttgcaagctttgtcaccaggtcacacttttggcagccaatcaatagatttatctcattaaactggcagaagagtgtttcaatgcatgctccaacagctacctggaaatagcaattgtgagagatgctaaggtaaggatattccagttcctataaccgtctgattttttgtccttgtgaattttcaatctgctgttttactgggatagctaagttccaggtttattttctcaggtaggctcacccacgacctctgtcctgtggtttgcattcctgaacatctgttagtctttcaaatgcaaggcacaaaactaacctcaagagtgtggctagatctgggagtgaacacagggcctgtccctcacagacgagaggtcaggagcacctttgtttcccaaggcaggttcttgattgatttaccttcatgcgttgatgtctttgctatgtgtgtaaaatgcatgtgttgctgaatcacatgtgaagctctacatgctggggtttatactgtgtttggcatgttgtgggagctcaataaatactaaatcagttgcacagtc

SEQ ID NO: 169333 - DNA, 585 bp, Homo sapiens
  Payload ID: 13332
  Gene Symbol: PIP
  Gene Name: prolactin-induced protein
  Uniprot ID: P12273
  ENST ID: ENST00000291009
  CDS Start-End: 41-481
accacttctctgggacacattgccttctgttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgcttctcca

SEQ ID NO: 169334 - DNA, 1344 bp, Homo sapiens
  Payload ID: 13333
  Gene Symbol: PCNA
  Gene Name: proliferating cell nuclear antigen
  Uniprot ID: P12004
  ENST ID: ENST00000379143
  CDS Start-End: 229-1014
gggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatca

SEQ ID NO: 169335 - DNA, 1359 bp, Homo sapiens
  Payload ID: 13333
  Gene Symbol: PCNA
  Gene Name: proliferating cell nuclear antigen
  Uniprot ID: P12004
  ENST ID: ENST00000379160
  CDS Start-End: 244-1029
ccgcggatggccggagctggcgccctggttctggaggtaaccggttactgagggcgagaagcgccacccggaggctctagcctgacaaatgcttgctgacctgggccagagctcttcccttacgcaagtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatca

SEQ ID NO: 169336 - DNA, 2577 bp, Homo sapiens
  Payload ID: 13334
  Gene Symbol: PA2G4
  Gene Name: proliferation-associated 2G4, 38kDa
  Uniprot ID: Q9UQ80
  ENST ID: ENST00000303305
  CDS Start-End: 420-1604
gtttttccgggagagaccacgcttcccctcaagctccccaacggctccgccttcccgccggagcctgacccttcccagagtgcccggcgattccggcgtgcgaggcccttggagggcaaggccccagggcctggcttaggagcgcgagaggcaggctgggaattgtagttcgaaggccctcgagagcggctagagtctggcggccgagaggactagttgtcccagcgtgccctgcgcctcagcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgtttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaaca

SEQ ID NO: 169337 - DNA, 694 bp, Homo sapiens
  Payload ID: 13334
  Gene Symbol: PA2G4
  Gene Name: proliferation-associated 2G4, 38kDa
  ENST ID: ENST00000551061
  CDS Start-End: 501-694
tatagattgagattcctaacacctaattagagtgtctgagaaaggaatgcggtaacatttaacagtgcatcggcttcgagtcagcaattctgtctaccttcttgtccctgatgcctataaatttcatctagtctttgcgtgtatgtggggataccatggcaagaaccctctgaagttcataactctgtcctgtcacaccaaaggtagcatctttggaaagtctgaggccttgcctagggagatggattgtatatacccagttgtcacataatgtaaggaagagaagggaatgttgacctttcagcctcagggcaatggcaccagggagtattatggaaactcttaaattcaacttccaggtattccttgggtggtaactagacaatgaatacatacaaggctgacatgatgggattctgtcctcaggggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgc

SEQ ID NO: 169338 - DNA, 687 bp, Homo sapiens
  Payload ID: 13334
  Gene Symbol: PA2G4
  Gene Name: proliferation-associated 2G4, 38kDa
  ENST ID: ENST00000553057
  CDS Start-End: 126-687
tgagctactgaggggcccgcaccggtccgctgggcacggcgtggtgggaagacccggtgtcgcgcctgggacctgagcgggcaggcccaggctgaagtctatggaggtgcgggtcggcgaccaggatgagcgcagagaggggaccctggcaggctccgacccgaggccgtttgttaggaggggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaa

SEQ ID NO: 169339 - DNA, 1085 bp, Homo sapiens
  Payload ID: 13334
  Gene Symbol: PA2G4
  Gene Name: proliferation-associated 2G4, 38kDa
  ENST ID: ENST00000552766
  CDS Start-End: 202-1056
gtcccagcgtgccctgcgcctcagcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgtttttaaacacattgaaaatgacatgacattaaaataaatttggatttgctcataa

SEQ ID NO: 169340 - DNA, 5168 bp, Homo sapiens
  Payload ID: 13335
  Gene Symbol: PROSER1
  Gene Name: proline and serine rich 1
  Uniprot ID: Q86XN7
  ENST ID: ENST00000352251
  CDS Start-End: 835-3669
ccaagctggcggcgcagtgttgagtttacttgggcgcgactggctttattgtaggtccccatgagctggtgggggctgtaggggtaaccaggcagggcgtctggcgctgttggggctgcgtttttccggagtccccctatgcgaggccgtgcccctcttcgcccggctcctggtgctccccagccgccggcccgctcccggaagctgcagcagctggtaacaaagagcctgccgggccgcctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggctgttttgacagaatacaaattaaaagcaattgaatatgtgcatggatacttttctagtgaacaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactctgactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagtgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaatattctgtgttttactaagtgcttggataggctttctaattttgtatacgtgctagagttaattattgaacatttttatccaaatttagttgtaactctgtttatactactgattgctcattcgtttaaatgatattttaatgtaaaagtcataaccaacatatgaacagacagatttatgtctttaaacacagaatgtaagctatagtttaatctgataccagttgctggaagttgccatttgtttttcttaaatctatacccataaaacttcttttaagatt

SEQ ID NO: 169341 - DNA, 898 bp, Homo sapiens
  Payload ID: 13335
  Gene Symbol: PROSER1
  Gene Name: proline and serine rich 1
  ENST ID: ENST00000418503
  CDS Start-End: 596-898
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacag

SEQ ID NO: 169342 - DNA, 5102 bp, Homo sapiens
  Payload ID: 13335
  Gene Symbol: PROSER1
  Gene Name: proline and serine rich 1
  Uniprot ID: Q86XN7
  ENST ID: ENST00000625998
  CDS Start-End: 835-3603
ccaagctggcggcgcagtgttgagtttacttgggcgcgactggctttattgtaggtccccatgagctggtgggggctgtaggggtaaccaggcagggcgtctggcgctgttggggctgcgtttttccggagtccccctatgcgaggccgtgcccctcttcgcccggctcctggtgctccccagccgccggcccgctcccggaagctgcagcagctggtaacaaagagcctgccgggccgcctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactctgactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagtgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaatattctgtgttttactaagtgcttggataggctttctaattttgtatacgtgctagagttaattattgaacatttttatccaaatttagttgtaactctgtttatactactgattgctcattcgtttaaatgatattttaatgtaaaagtcataaccaacatatgaacagacagatttatgtctttaaacacagaatgtaagctatagtttaatctgataccagttgctggaagttgccatttgtttttcttaaatctatacccataaaacttcttttaagatt

SEQ ID NO: 169343 - DNA, 3333 bp, Homo sapiens
  Payload ID: 13336
  Gene Symbol: PROSER2
  Gene Name: proline and serine rich 2
  Uniprot ID: Q86WR7
  ENST ID: ENST00000277570
  CDS Start-End: 155-1462
gggcggcggcgtgagggctccgggtcgctggcggcgtggacacctgagtcccggggtaggggtctcccgcgaggagtgagctgttgccgcagaatgggctgctggctcctgccctgcttcctgtgatcgagccggccctgaggactctgtggagatgcctgtaacccaccggaaatcagacgcatctgacatgaactcagacacgtcccccagctgcaggctccgagccttcagcagaggcggcagcctggagagtcgaagcagcagctctcgctccagaagcttcactttggatgatgagagcctgaagtacctcacccatgaggaaaaggatgtgctcctgttttttgaagagacgattgactccctagacgaggactttgaggagccagtgctgtgcgatggaggagtgtgctgcctctgctccccgtctctggaggagagcacctccagtccctccgagcctgaagatgtcatcgacttagtgcagccagcacctggcgccggggaagccgagggccttccagaggggacccaggcagcagggcctgcacctgctgggaaggagcacaggaaacaagatgctgagactcctccacctccagaccccccggctcccgagacccttcttgcgccaccacccctgcctagcacccccgatccccccaggagggagctgcgcgccccctccccgccggtggagcaccccagactcctgcgctctgttcccacgcccctcgttatggcgcagaagatttccgagaggatggcggggaacgaagccctctcgcccacctccccgttcagggagggccggcccggggagtggaggacacctgccgcccgggggccccgcagtggagaccctggcccggggcccagccacccggcgcagcccaaggcaccccgcttccccagcaacatcatcgtcaccaacggcgcggcccgggagccccgcaggaccctgtccagggcggccgtcagcgtgcaggagcgcagggcgcaggtgttggccaccatccacggccacgccggcgccttccccgccgcgggggacgccggcgagggggccccagggggcggctcctccccggagcgggtggcgcgtggccggggcctgccgggccccgctgagagtctccgggcagggggtcaggctccgcggggcccggcgctggccaacggcttcccaagtgcgcacgaggccctgaagagcgcacccagctccttcgcgcccgctgggaagtccctctgcttccgccctggcccggccctgcccagcacgcgggcccgtcagagcttccccgggccccggcagcccaacggcgcccaggactggcgccgcgcagactccctgccccggccccagggcatcaccgtgcagttcgcgggccgcggctcctcggaggaggcgcgcagggaggccctgcggaagctggggctgctcagggagagttcgtgagggccgcgcgggctccagtccaccccgtttctccccaccctgaagagagggtgaaagagtcgctgcacccaggagctgtttggtctaaaatggaagtgacagcgggagcccctgccctctgtggcacatcggagtctagaggtgcctggctggggcctcctggctgagcacgcaccgcaagctccagccaccggcacagagaactcttccctaaaggaatctggccgagggcttgtctcccttttcccaagaactgagagagagagaataacctgttagacccataggtttccgtgatgtgtaaatgccatcttttgggggttgggaggagtaggactggtctgattatcattcttgagtctcatctaccctcttctcgaagtacatgacatgaaagttcagatcccttccactcaggattctcgccgccttttctaagaaaataataaaaaaaaatgcttgtttcattttttaatgtcttaatatacttgcttttgtttttgaagggtgaggcatcatggtactttgcttttgtttcttgacgtactttagtttgcccagttttgttttttactgaaaactgaaatgaaacctttagatattgagttttgggagtgaaatggaaaggtggtaattttgagaaagcaagtctcatcagactctgaggtctgggacgtgtgcgtgagcctgtgtttgtgtgtgtatgtttttagatacgtacgtgtcaacacatacatgcataggtatcctgtgtgtccacatgcatcattattatataaatagaaacttctgaacaccctcctaagtcactacaggatgccagcgcttcctattcttgggtagacagagccacctcagcatcctgatggatgatacaagaaattgttacttcctagtatggaagtgtcttaaggacacgtctccatgatattttggtgaaccaaaagtgctttatcctcaacaaaatgttcctctgttcccagttaaagtaatattccctgcttccaagtaagcaagactgttcactaaagaaggaactttttagaaaactaatctcctttatcatccaattttagttctgcatgttccgaggtagccagtcaacagaaggaagcaaaagattcttaaagatccaccgactgtcatgttccacaagcaagatctcagggtagggaaaaaccagtgaatgaggttacacagcaggaaaagaaccggtttcctcccagactatgtcttacacgctgagttatgccacaagcgttatcatcaaaactatttaaggctggagtcttagacctctaaaaatagacaggaagggctgccctgagcagtgacacctttgtgtttttatgtctccgccagcgccgtaacagagcctgtttctttcccgttgagtattacttaaattcaggcttaaatgtgctatgaagggcatttttcatagtatcccatttgccttgtaagttatataaagtgcatgattataattttttccttagaaatgcaatatttagtttcatccagctcttatgaataataacctcatagattcctgatcttaatttaaataggtgctttaattttacagctttcaaaagtagttactgtaaattttactcctgttaatgctggattggtttaaaggatttataagggctgtgtttgctctttacaaggcaagatgccatacagtgttcaataatagaaggtcttgatacaaccgacattttaaatattctttatacatgaggactgcatctttttcactgaccctatgatttcactgtgagtagggtgaactggactgcatattagtttatttgttgccataatcacatttttgaaaaataaatttaagagttttttcttaa

SEQ ID NO: 169344 - DNA, 1232 bp, Homo sapiens
  Payload ID: 13336
  Gene Symbol: PROSER2
  Gene Name: proline and serine rich 2
  ENST ID: ENST00000379200
  CDS Start-End: 44-763
ggagcaccccagactcctgcgctctgttcccacgcccctcgttatggcgcagaagatttccgagaggatggcggggaacgaagccctctcgcccacctccccgttcagggagggccggcccggggagtggaggacacctgccgcccgggggccccgcagtggagaccctggcccggggcccagccacccggcgcagcccaaggcaccccgcttccccagcaacatcatcgtcaccaacggcgcggcccgggagccccgcaggaccctgtccagggcggccgtcagcgtgcaggagcgcagggcgcaggtgttggccaccatccacggccacgccggcgccttccccgccgcgggggacgccggcgagggggccccagggggcggctcctccccggagcgggtggcgcgtggccggggcctgccgggccccgctgagagtctccgggcagggggtcaggctccgcggggcccggcgctggccaacggcttcccaagtgcgcacgaggccctgaagagcgcacccagctccttcgcgcccgctgggaagtccctctgcttccgccctggcccggccctgcccagcacgcgggcccgtcagagcttccccgggccccggcagcccaacggcgcccaggactggcgccgcgcagactccctgccccggccccagggcatcaccgtgcagttcgcgggccgcggctcctcggaggaggcgcgcagggaggccctgcggaagctggggctgctcagggagagttcgtgagggccgcgcgggctccagtccaccccgtttctccccaccctgaagagagggtgaaagagtcgctgcacccaggagctgtttggtctaaaatggaagtgacagcgggagcccctgccctctgtggcacatcggagtctagaggtgcctggctggggcctcctggctgagcacgcaccgcaagctccagccaccggcacagagaactcttccctaaaggaatctggccgagggcttgtctcccttttcccaagaactgagagagagagaataacctgttagacccataggtttccgtgatgtgtaaatgccatcttttgggggttgggaggagtaggactggtctgattatcattcttgagtctcatctaccctcttctcgaagtacatgacatgaaagttcagatcccttccactcaggattctcgccgccttttctaagaaaataataaaaaaaaatgcttgtttcatt

SEQ ID NO: 169345 - DNA, 476 bp, Homo sapiens
  Payload ID: 13336
  Gene Symbol: PROSER2
  Gene Name: proline and serine rich 2
  ENST ID: ENST00000444604
  CDS Start-End: 222-476
ccaatcagatgtctggtcaagattgttttcaggtgagattttactttaggaaaatctggttttggtatctttttcagtgatggcgaaccgacactaggaaacttcttccctcgaggcctgttaaaacccagcctctctaggagtgagctgttgccgcagaatgggctgctggctcctgccctgcttcctgtgatcgagccggccctgaggactctgtggagatgcctgtaacccaccggaaatcagacgcatctgacatgaactcagacacgtcccccagctgcaggctccgagccttcagcagaggcggcagcctggagagtcgaagcagcagctctcgctccagaagcttcactttggatgatgagagcctgaagtacctcacccatgaggaaaaggatgtgctcctgttttttgaagagacgattgactccctagacgaggactttgaggagccagtgctgtgcgatggagga

SEQ ID NO: 169346 - DNA, 1646 bp, Homo sapiens
  Payload ID: 13336
  Gene Symbol: PROSER2
  Gene Name: proline and serine rich 2
  Uniprot ID: Q86WR7
  ENST ID: ENST00000622831
  CDS Start-End: 155-1180
gggcggcggcgtgagggctccgggtcgctggcggcgtggacacctgagtcccggggtaggggtctcccgcgaggagtgagctgttgccgcagaatgggctgctggctcctgccctgcttcctgtgatcgagccggccctgaggactctgtggagatgcctgtaacccaccggaaatcagacgcatctgacatgaactcagacacgtcccccagctgcaggctccgagccttcagcagaggcggcagcctggagagtcgaagcagcagctctcgctccagaagcttcactttggatgatgagagcctgaagtacctcacccatgaggaaaaggatgtgctcctgttttttgaagagacgattgactccctagacgaggactttgaggagccagtgctgtgcgatggaggagtgtgctgcctctgctccccgtctctggaggagagcacctccagtccctccgagcctgaagatgtcatcgacttagtgcagccagcacctggcgccggggaagccgagggccttccagaggggacccaggcagcagggcctgcacctgctgggaaggagcacaggaaacaagatgctgagactcctccacctccagaccccccggctcccgagacccttcttgcgccaccacccctgcctagcacccccgatccccccaggagggagctgcgcgccccctccccgccggtggagcaccccagactcctgcgctctgttcccacgcccctcgttatggcgcagaagatttccgagaggatggcggggaacgaagccctctcgcccacctccccgttcagggagggccggcccggggagtggaggacacctgccgcccgggggccccgcagtggagaccctggcccggggcccagccacccggcgctggccaacggcttcccaagtgcgcacgaggccctgaagagcgcacccagctccttcgcgcccgctgggaagtccctctgcttccgccctggcccggccctgcccagcacgcgggcccgtcagagcttccccgggccccggcagcccaacggcgcccaggactggcgccgcgcagactccctgccccggccccagggcatcaccgtgcagttcgcgggccgcggctcctcggaggaggcgcgcagggaggccctgcggaagctggggctgctcagggagagttcgtgagggccgcgcgggctccagtccaccccgtttctccccaccctgaagagagggtgaaagagtcgctgcacccaggagctgtttggtctaaaatggaagtgacagcgggagcccctgccctctgtggcacatcggagtctagaggtgcctggctggggcctcctggctgagcacgcaccgcaagctccagccaccggcacagagaactcttccctaaaggaatctggccgagggcttgtctcccttttcccaagaactgagagagagagaataacctgttagacccataggtttccgtgatgtgtaaatgccatcttttgggggttgggaggagtaggactggtctgattatcattcttgagtctcatctaccctcttctcgaagtacatgacatgaaagttcagatcccttccactcaggattctcgccgccttttctaagaaaataataaaaaaaaatgcttgtttc

SEQ ID NO: 169347 - DNA, 826 bp, Homo sapiens
  Payload ID: 13337
  Gene Symbol: PROSER3
  Gene Name: proline and serine rich 3
  ENST ID: ENST00000301165
  CDS Start-End: 61-826
gcgcgcggggcctgttgggtgaaggagcagagcggccggaagcgcggagggagccgcgggatggaccgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcaggagccaacaaaccagaaggaagaccccatacagctgtccctactgcggtcaacgtgaccagtgcatcccatgctgtggctccccttcaggaaataaagcagaacctccacacatggaactcatccctgctggacctggagacgctgagcctacagagcagagctgccaggctgctcaaacgcagcaaagcctccatctcctcctcctcctccctcagccccagcgatgccagcacttcctcattccccaccagctctgatggcctctctcccttctcggagaccttcatccctgactccagcaagggccttggccccagggcacccg

SEQ ID NO: 169348 - DNA, 2149 bp, Homo sapiens
  Payload ID: 13337
  Gene Symbol: PROSER3
  Gene Name: proline and serine rich 3
  Uniprot ID: Q2NL68
  ENST ID: ENST00000396908
  CDS Start-End: 64-1506
gatgcgcgcggggcctgttgggtgaaggagcagagcggccggaagcgcggagggagccgcgggatggaccgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcagcaggagccaacaaaccagaaggaagaccccatacagctgtccctactgcggtcaacgtgaccagtgcatcccatgctgtggctccccttcaggaaataaagcagaacctccacacatggaactcatccctgctggacctggagacgctgagcctacagagcagagctgccaggctgctcaaacgcagcaaagcctccatctcctcctcctcctccctcagccccagcgatgccagcacttcctcattccccaccagctctgatggcctctctcccttctcggagaccttcatccctgactccagcaagggccttggccccagggcacccgcatccccggcaccagcccaggcccagacccccacccctgctccagccccagcctcctcccaagcaccccttcggccagaggatgacattctgtaccagtggcggcagcggcggaagcttgaacaggctcagggaagcaagggtgacagagcttgggtgccgcctctgacccctgccctccgcacgttggccgagtctctgaaagccaaggccttgccgcccgcagcggggtcagtgatacggaagagcgaagccactccttcccctggagcctgcctgcagcccgaggtcccactctctccagctgagcaggcaaccacagtcaaggcctcgccgccagccttccaggtggggtctccggaggccctggccccgcccccgcccgctgctgaccacgccccctcggaggccctgcttgcccaggccgccctgctgctgcaggctgcagaagactccgacggcagcgagttccaggacgatcccgtgctgcaggtgctaagagcccatagggcagagctgagtcggcagaaaagggaagcggatgcccgattatcgttcctgttggaccaggctgaagacctgggatcttggtcccctccagccgggtcgccccctaggtccccaaggaggctgctaagaagggaaggagattccctggaggccagaagactttgaattgtacagattctattttacccagtgaggctctttttttttttttcatacagttactggttatctgtgagaaaggggttgtttggaaaggccaaggggtcatgccaatttaaggaaatgccccccatcctccgctgccccatggctctgccctgccccccaccccttcctgaccacggaaacaagatctcctttctggttatatcttccttggggcagagggagtttcagacaagacttctggcaagactgggacccaccttatctggcttcactcaggagccctggctcaaatggaccaaaggactgccctccacggaggaagctactagggtcatcagagtgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctagacctggccacgaa

SEQ ID NO: 169349 - DNA, 579 bp, Homo sapiens
  Payload ID: 13337
  Gene Symbol: PROSER3
  Gene Name: proline and serine rich 3
  ENST ID: ENST00000444637
  CDS Start-End: 321-579
aagcgacggagatgcgcgcggggcctgttgggtgaaggagcagagcggccggaagcgcggagggagccgcgggatggaccgcagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcaggagccaacaaaccagaaggaagaccccatacagctgtccctactgcggtcaacgtgaccagtgcatcccatgctg

SEQ ID NO: 169350 - DNA, 387 bp, Homo sapiens
  Payload ID: 13337
  Gene Symbol: PROSER3
  Gene Name: proline and serine rich 3
  ENST ID: ENST00000539771
  CDS Start-End: 1-158
ccattcaagatagtccctttggagatgcgcccctgggtcgaagccactactggccatcccagagccagacctggtgtcccaaggtatataaacaggttccgccaggctcagcccaccagtcgagaggagcgccagcctgcaggcccaaccccagctgacttttggtggctgcagtctgactctccagaccccagcagtcaaagtgcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctaggacagaattagaagatca

SEQ ID NO: 169351 - DNA, 772 bp, Homo sapiens
  Payload ID: 13337
  Gene Symbol: PROSER3
  Gene Name: proline and serine rich 3
  Uniprot ID: Q2NL68
  ENST ID: ENST00000537459
  CDS Start-End: 23-607
gaagcgcggagggagccgcgggatggaccgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctaggacagaattagaagatcaggagcagtggctcacacctgtaatcccagcactttgggaggccaaggtgagaggactgcttgaggccaggagttcaagaccagcttgggtgacatggtgagattctgcctctactaaaaaaaaaaaaaaaaa

SEQ ID NO: 169352 - DNA, 612 bp, Homo sapiens
  Payload ID: 13337
  Gene Symbol: PROSER3
  Gene Name: proline and serine rich 3
  ENST ID: ENST00000545674
  CDS Start-End: 332-612
ttgtctggttctgccctcctctaatgtccccctccccagggctgcggcgaaaccacgtgctgcctgaaccccactttcctcttgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcaggagccaacaaaccagaaggaagaccccatacagctgtccctactgcggtcaacgtgaccagtgcatcccatgctgtggctccccttcaggaaataaa

SEQ ID NO: 169353 - DNA, 1266 bp, Homo sapiens
  Payload ID: 13337
  Gene Symbol: PROSER3
  Gene Name: proline and serine rich 3
  Uniprot ID: Q2NL68
  ENST ID: ENST00000536950
  CDS Start-End: 38-619
ggagcagagcggccggaagcgcggagggagccgcgggatggaccgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctaggacagaattagaagatcaggagcagtggctcacacctgtaatcccagcactttgggaggccaaggtgagaggactgcttgaggccaggagttcaagaccagcttgggtgacatggtgagattctgcctctactaaaaaaaaaaaaaaaaagagagagagagagagaaccaggtgtggtggtatgtacctgtaatcccagctacttgagagcctgaggctggaggatggcttgagcctaggagttcaaggctgctgtgagctatgatcatgccactgcactccagcctgggcagtagagcaagaccctgtctctatttaaaaaaaaaaaaaaaaaaaaagcctgggcaccgtggctcatgcctataatcccagcactttggtaggctgaggcaggcagatcacgaggtcaggagttcaggaccagcctgaccaacatggtgaaaccccgtctctactaaaaatacaaaaattagccgggcgtggtggtacacacctgtaatcccagctactcaggagcctgaggcaggagaattgcttgaacccgggagacggaggttgcagtgagccaagatagcgccagcgcactccagcctggcgacagcaagactccatctcaaaaaaaaaaaaaaaag

SEQ ID NO: 169354 - DNA, 650 bp, Homo sapiens
  Payload ID: 13337
  Gene Symbol: PROSER3
  Gene Name: proline and serine rich 3
  ENST ID: ENST00000421853
  CDS Start-End: 19-303
cgcggagggagccgcgggatggaccgcaggtatataaacaggttccgccaggctcagcccaccagtcgagaggagcgccagcctgcaggcccaaccccagctgacttttggtggctgcagtctgactctccagaccccagcagtcaaagtgcagcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctaggacagaattagaagatcaggagcagtggctcacacctgtaatcccagcactttgggaggccaaggtgagaggactgcttgaggccaggagttcaagaccagcttgggtgacatggtgagattctgcctctactaaaaaaaaaaaaaaaaagagagagagagagagaaccaggtgtggtggtatgtacctgtaatcccagctacttgagagcctgaggctggaggatggcttgagcctaggagttcaaggctgctgtgagctatgatcatgccactgcactccagcctgggcagtagagcaagaccctgtctctatttaaaaaaaaaaaaaaa

SEQ ID NO: 169355 - DNA, 732 bp, Homo sapiens
  Payload ID: 13337
  Gene Symbol: PROSER3
  Gene Name: proline and serine rich 3
  ENST ID: ENST00000601095
  CDS Start-End: 1-503
cccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctaggacagaattagaagatcaggagcagtggctcacacctgtaatcccagcactttgggaggccaagaacctccacacatggaactcatccctgctggacctggagacgctgagcctacagagcagagctgccaggctgctcaaacgcagcaaagcctccatctcctcctcctcctccctcagccccagcgatgccagcacttcctcattccccacc

SEQ ID NO: 169356 - DNA, 461 bp, Homo sapiens
  Payload ID: 13337
  Gene Symbol: PROSER3
  Gene Name: proline and serine rich 3
  ENST ID: ENST00000542134
  CDS Start-End: 1-273
tggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcaggtacctctttcagtgccatccactactcccacccctaaacctttgctgatcaatgcccccagcagccactcctcctggccctcatacctcaactggggcttctcagcaggagccaacaaaccagaaggaagaccccatacagctgtccctactgcggtcaacgtgaccagtgcatcccatgctgtggctccccttcaggaaataaagcaggtgacatccccattca

SEQ ID NO: 169357 - DNA, 3606 bp, Homo sapiens
  Payload ID: 13337
  Gene Symbol: PROSER3
  Gene Name: proline and serine rich 3
  ENST ID: ENST00000620918
  CDS Start-End: 33-1007
agagcggccggaagcgcggagggagccgcgggatggaccgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcaggagccaacaaaccagaaggaagaccccatacagctgtccctactgcggtcaacgtgaccagtgcatcccatgctgtggctccccttcaggaaataaagcagaacctccacacatggaactcatccctgctggacctggagacgctgagcctacagagcagagctgccaggctgctcaaacgcagccccagcgatgccagcacttcctcattccccaccagctctgatggcctctctcccttctcggagaccttcatccctgactccagcaagggccttggccccagggcacccgcatccccggcaccagcccaggcccagacccccacccctgctccagccccagcctcctcccaagcaccccttcggccagaggatgacattctgtaccagtggcggcagcggcggaagcttgaacaggctcagggaagcaagggtgacagagcttgggtgccgcctctgacccctgccctccgcacgttggtgagccgagggagggaggagcctggggggagctggaggaggggctgggtctgagggggactgaggaccctccaccctctctctctctgtctcagatctctcttatctgtctacagacctctcctgctccagtggagaccctcagttctctggggacccagcctaaccatgtcccactgtggagcagtgtggcccagcctggtccaccagaggccttctatgtggagaggcctccttttccctcagtgtcctctccacacatcttttgggcccccagctcccacgggttcttctgggccccacagtctgggccttgggtatcccttggggctgttcctcccacgcagcaggcctccaccctagcacatctgggctctaccctcgcgcccccggcttccctggcctccaccctcgaacccccggcctccaccccagctcccctggcctccacccttgcacccccagcctccaccccggctcccctggcctgtacccctgcacctccagcctccaccctcgcatccccagctgtcccccagggcctgcccatccctgacccaagcagctgtgcccagcctaagagcctggggcccaagtctcggaggagcagagcccctcgcccagaggctgccgagcaagtccctgcagctggccagggacctggccctcagctcaggggtgtcctgggccaggtagtggcagctcggctgttccctgacagcctggaggacacgcctcctcacttcgagggcccccctccacccaaggctggatctccgaaagtccaggccacacaaccccaaaccaaggtcactccccctccatctgaatcccagtgtcgggccaaggccgagtctctgaaagccaaggccttgccgcccgcagcggggtcagtgatacggaagagcgaagccactccttcccctggagcctgcctgcagcccgaggtcccactctctccagctgagcaggcaaccacagtcaaggcctcgccgccagccttccaggtggggtctccggaggccctggccccgcccccgcccgctgctgaccacgccccctcggaggccctgcttgcccaggccgccctgctgctgcaggctgcagaagactccgacggcagcgagttccaggacgatcccgtgctgcaggtgctaagagcccatagggcagagctgagtcggcagaaaagggaagcggatgcccgattatcgttcctgttggaccaggctgaagacctgggatcttggtcccctccagccgggtcgccccctaggtccccaaggaggctgctaagaagggaaggagattccctggaggccagaagactttgaattgtacagattctattttacccagtgaggctctttttttttttttcatacagttactggttatctgtgagaaaggggttgtttggaaaggccaaggggtcatgccaatttaaggaaatgccccccatcctccgctgccccatggctctgccctgccccccaccccttcctgaccacggaaacaagatctcctttctggttatatcttccttggggcagagggagtttcagacaagacttctggcaagactgggacccaccttatctggcttcactcaggagccctggctcaaatggaccaaaggactgccctccacggaggaagctactagggtcatcagagtgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctagacctggccacgaaaccttgggctcctacctcattaccatttctacccaagggtttaaaagacatctcaaattccataggtcctaaatggagtttccaatctttccccctaggcgtgcctctccccagcttctttttttttttttttttggatggagtctagctctgtcacccaggctggagtgccatagtgtgatctcggctcactgcaagcttcgcctcccgggttcacgccattctcctgcctcagcctcccgagtagctgggactacaggtgcccgccaccacggtcggctaattttttttgtatttttagtagagacggggtttcactgtgttagccaggatggtcttggtctcctgacctcgtgatccacccgcctcggcctcccaaagtgctgggattgcaggcgtgagccaccgtgctgggccccccctccccaactttcttcggctctgtcctttgccgctcagaccaaaaaccttagagttgtctttgacttctgtctttcccttccacccacagttaaccaggaaatcctgccatctccgcctttattttattttattttttgagatggagtttcacccttgttgcccaggctgtagtacaatggcatgatctcggctcacggcaacctccacctcccgggttcaagcgattctcctgcctcagccttctgagtagctg

SEQ ID NO: 169358 - DNA, 1985 bp, Homo sapiens
  Payload ID: 13338
  Gene Symbol: PRODH
  Gene Name: proline dehydrogenase (oxidase) 1
  ENST ID: ENST00000334029
  CDS Start-End: 114-1592
gctgaagtgccagggtgcttgtgaagtctaagcccttgtctggcatttgtcaggaatataggctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 169359 - DNA, 2462 bp, Homo sapiens
  Payload ID: 13338
  Gene Symbol: PRODH
  Gene Name: proline dehydrogenase (oxidase) 1
  Uniprot ID: O43272
  ENST ID: ENST00000357068
  CDS Start-End: 267-2069
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatatagggtgaggcctctgggaccgagcggggcggggcggggcggggcggggcggggcgggaccaacagcgcacacttaagcggcccgggcgggtaccgccgtcccgccatggctctgaggcgcgccctgcccgcgctgcgcccctgcattccccgcttcgtcccgctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 169360 - DNA, 594 bp, Homo sapiens
  Payload ID: 13338
  Gene Symbol: PRODH
  Gene Name: proline dehydrogenase (oxidase) 1
  ENST ID: ENST00000450579
  CDS Start-End: 190-594
gggccagtcgtgcagaagccatgcccaccttgtggccgggatggagtggggactaggaaggcaccagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagg

SEQ ID NO: 169361 - DNA, 553 bp, Homo sapiens
  Payload ID: 13338
  Gene Symbol: PRODH
  Gene Name: proline dehydrogenase (oxidase) 1
  ENST ID: ENST00000438924
  CDS Start-End: 1-553
cggtgcccgccgtggacttcggcaacgcgcaggaggcgtaccgcagccggcgaacctgggagctggcgcggagcctgctggtgctgcgcttgtgcgcctggcccgcgctgctggcgcgccacgagcaggtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcagctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcagg

SEQ ID NO: 169362 - DNA, 2034 bp, Homo sapiens
  Payload ID: 13338
  Gene Symbol: PRODH
  Gene Name: proline dehydrogenase (oxidase) 1
  ENST ID: ENST00000420436
  CDS Start-End: 162-1640
cgtcccgccatggctctgaggcgcgccctgcccgcgctgcgcccctgcattccccgcttcgtcccgctgtccacggcgccggcctcccgcgagcagcccgcagcgggcccagcggccgtgccaggaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgca

SEQ ID NO: 169363 - DNA, 491 bp, Homo sapiens
  Payload ID: 13338
  Gene Symbol: PRODH
  Gene Name: proline dehydrogenase (oxidase) 1
  ENST ID: ENST00000457083
  CDS Start-End: 1-491
cccgcgctgcgcccctgcattccccgcttcgtcccgctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcaggtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcagctgcagttctcagaggtgctggccaagtggaggtgcttctttcaccaaatggct

SEQ ID NO: 169364 - DNA, 2405 bp, Homo sapiens
  Payload ID: 13338
  Gene Symbol: PRODH
  Gene Name: proline dehydrogenase (oxidase) 1
  ENST ID: ENST00000610940
  CDS Start-End: 205-2007
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtcccgctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgcagctg

SEQ ID NO: 169365 - DNA, 1677 bp, Homo sapiens
  Payload ID: 13339
  Gene Symbol: PRODH2
  Gene Name: proline dehydrogenase (oxidase) 2
  Uniprot ID: Q9UF12
  ENST ID: ENST00000301175
  CDS Start-End: 19-1629
tagagatggggtctcactatgtcgcccagggtagtctcaaactcctcggtcttggcctcccaaagtgttgggattacaaacgtgagaaccgtattttcaaatgtattcaataacactacagcgtttccaattttaagaggaagcaattgccacaaaatcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagacagcagaggaggtgaagggctgcgtgcagcagctgcggaccctcagcctccgaccactgctggcagtgcccactgaggaggagccggactctgctgccaagagtggtgaggcgtggtatgaggggaacctcggtgctatgctgcggtgtgtggacctgtcacggggcctcctggagccccccagcctggctgaggccagcctcatgcagctgaaggtgacggcgctgaccagtactcggctctgtaaggagctagcctcgtgggtcagaaggccaggagcctccttggagctgagccccgagaggctggctgaagctatggactctgggcagaacctccaggtctcctgcctcaatgctgagcagaaccagcacctccgggcctccctcagccgcctgcatcgggtggcacagtatgcccgggcccagcacgtgcggctcctggtggatgcggagtacacctcactgaaccctgcgctctcgctgctggtggctgccctggctgtgcgctggaacagcccgggtgaaggcgggccctgggtgtggaacacctaccaggcctgtctaaaggacacattcgagcggctggggagggatgcagaggctgcgcacagggccggcctggccttcggagtgaagctggtacgaggtgcatatctggacaaggagagagcggtggcccagctccatgggatggaagaccccactcagcctgactatgaggccaccagtcagagttacagccgctgcctggaactgatgctgacgcacgtggcccgccatggccccatgtgccacctcatggtggcttcccacaatgaggaatctgttcgccaggcaaccaagcgcatgtgggagctgggcattcctctggatgggactgtctgtttcggacaacttctgggcatgtgtgaccacgtctctctagcactggggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcct

SEQ ID NO: 169366 - DNA, 567 bp, Homo sapiens
  Payload ID: 13339
  Gene Symbol: PRODH2
  Gene Name: proline dehydrogenase (oxidase) 2
  ENST ID: ENST00000588266
  CDS Start-End: 1-359
acagcccgggtgaaggcgggccctgggtgtggaacacctaccaggcctgtctaaaggacacattcgagcggctggggagggatgcagaggctgcgcacagggccggcctggccttcggagtgaagctggtacgaggtgcatatctggacaaggagagagcggtggcccagctccatgggatggaagaccccactcagcctgactatgaggccaccagtcagagttacagccgctgcctggaactgatgctgacgcacgtggcccgccatggccccatgtgccacctcatggtggcttcccacaatgaggaatctgttcgccaggcaaccaagcgggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcct

SEQ ID NO: 169367 - DNA, 612 bp, Homo sapiens
  Payload ID: 13339
  Gene Symbol: PRODH2
  Gene Name: proline dehydrogenase (oxidase) 2
  ENST ID: ENST00000589835
  CDS Start-End: 1-222
gaggccaccagtcagagttacagccgctgcctggaactgatgctgacgcacgtggcccgccatggccccatgtgccacctcatggtggcttcccacaatgaggaatctgttcgccaggcaaccaagcgcatgtgggagctgggcattcctctggatgggactgtctgtttcggacaacttctgggcatgtgtgaccacgtctctctagcactgggtatgtgaatggctcccccacccccatcaagccccaggccttactccctcccagccagagcccttctcctattcccaaccaaggcccagcctccagatccttccagagagatctgtcattccagtgtctgtgggccttccaaggctgtgtctctgtgtctgccgtctgtcatttctgctggttcttgatcatggtgtattatttcttgtgtgttttgttatctttactgtgctgctcctcagggcctgacaccaggtaattaatgtttccttctgccaggtgctaagcagaacgaaatcactttatcctaaattcatagcttgaggtttcttgaaacaccccactggcacaaatttgagctgcaaatacataagggggttaacccatagccccaactt

SEQ ID NO: 169368 - DNA, 2332 bp, Homo sapiens
  Payload ID: 13340
  Gene Symbol: PRR11
  Gene Name: proline rich 11
  Uniprot ID: Q96HE9
  ENST ID: ENST00000262293
  CDS Start-End: 313-1395
accagagcttccaccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctaaggcaggagaattgcttgaacccaagaggcagaggttgcagtgagccaagatcgcgtcattgcactccagcctgagcaacaagagcaaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctctaaaaa

SEQ ID NO: 169369 - DNA, 536 bp, Homo sapiens
  Payload ID: 13340
  Gene Symbol: PRR11
  Gene Name: proline rich 11
  ENST ID: ENST00000582995
  CDS Start-End: 103-536
ctttatggcgtgggagaggccacagcccggactccatcgactcccccggctcttagactatttctcgctctgtgttccaggctggagtacagtggcgcagtcatgggtcactgcagcctcaagctcctgtgctcacgtgagcctcccgcctcacccttcagagtggctaggactatagaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaaca

SEQ ID NO: 169370 - DNA, 1641 bp, Homo sapiens
  Payload ID: 13340
  Gene Symbol: PRR11
  Gene Name: proline rich 11
  Uniprot ID: Q96HE9
  ENST ID: ENST00000580177
  CDS Start-End: 55-1137
gggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtgatccacccatctcagcctcccaaagtgctgagattacaggcgtgagccaccacgcccggccagagatccacatctatatttataacacatttatggatgaaaattaaacaggtgtccgggtgcggttactcatgcctgtaatccgagcacttgtggaggccgaggcaggcggattacttgaggtcaggacttcgaaaccagcctggccaacatggtgaaatcccatctctactaaaaatacaaaattagccaggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaa

SEQ ID NO: 169371 - DNA, 232 bp, Homo sapiens
  Payload ID: 13340
  Gene Symbol: PRR11
  Gene Name: proline rich 11
  ENST ID: ENST00000582004
  CDS Start-End: 1-160
aaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcaggtaaccctttaggaaaagaatattggttcctttgcttgaaaataatttggcctggtgtggtggctcatgactgtaatcctaaca

SEQ ID NO: 169372 - DNA, 860 bp, Homo sapiens
  Payload ID: 13340
  Gene Symbol: PRR11
  Gene Name: proline rich 11
  ENST ID: ENST00000578777
  CDS Start-End: 264-860
aattttgaatttttctttatggcgtgggagaggccacagcccggactccatcgactcccccggctcttagactatttctcgctctgtgttccaggctggagtacagtggcgcagtcatgggtcactgcagcctcaagctcctgtgctcacgtgagcctcccgcctcacccttcagagtggctaggactatagagacattgttgctgaagccctctgtcctgtccttctgcggcagtcttcactggctgtgagcctcagaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccacca

SEQ ID NO: 169373 - DNA, 2334 bp, Homo sapiens
  Payload ID: 13340
  Gene Symbol: PRR11
  Gene Name: proline rich 11
  Uniprot ID: Q96HE9
  ENST ID: ENST00000578542
  CDS Start-End: 66-1148
ctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggacttcgaaaccagcctggccaacatggtgaaatcccatctctactaaaaatacaaaattagccaggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaattaaatgggtagtgacgttaagagatatatatcagcttctagtaaaagtttttttttttaaacctgctagctacatttacattatgtaaaaataaagggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgtgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctaaagcacgagaattatgtgcatcctggaggtgaaggttgcagtgagccaagatcacaccactccactccagtctggacaacagagtgagaccctgtgtc

SEQ ID NO: 169374 - DNA, 199 bp, Homo sapiens
  Payload ID: 13340
  Gene Symbol: PRR11
  Gene Name: proline rich 11
  ENST ID: ENST00000577457
  CDS Start-End: 133-199
tctttatggcgtgggagaggccacagcccggactccatcgactcccccggctcttagactaagacattgttgctgaagccctctgtcctgtccttctgcggcagtcttcactggctgtgagcctcagaaatcatgcccaagttcaaacaacgaagacgaaagctaaaagccaaagccgaaagattattcaaaaaaaaag

SEQ ID NO: 169375 - DNA, 1623 bp, Homo sapiens
  Payload ID: 13340
  Gene Symbol: PRR11
  Gene Name: proline rich 11
  Uniprot ID: Q96HE9
  ENST ID: ENST00000614081
  CDS Start-End: 55-1137
gggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtgatccacccatctcagcctcccaaagtgctgagattacaggcgtgagccaccacgcccggccagagatccacatctatatttataacacatttatggatgaaaattaaacaggtgtccgggtgcggttactcatgcctgtaatccgagcacttgtggaggccgaggcaggcggattacttgaggtcaggacttcgaaaccagcctggccaacatggtgaaatcccatctctactaaaaatacaaaattagccaggtgtggtgtcacgcacctgtagtcccagttacttgaacctgggaggcagaggttgcagtgagccgagattgcaacactgccactccagcctgggtgacagagcaagagaccctgtctc

SEQ ID NO: 169376 - DNA, 6955 bp, Homo sapiens
  Payload ID: 13341
  Gene Symbol: PRR12
  Gene Name: proline rich 12
  Uniprot ID: Q9ULL5
  ENST ID: ENST00000418929
  CDS Start-End: 13-6123
cgcggccaattcatggacaggaactaccccagcgccggcttcggggacccgctcggcgccggggcgggatggagttacgagaggtcagcgaaagctagcttggtttatggcagctccaggacctcgcaccccgagacggacatcttacaccgccaggcctatgcggccccccacccactgcaaagctatgccaccaaccaccacccggcaggcctctctggactcttcgacactggcctccaccacgcgggctcagcagggcccgacgcctccgtcatgaaccttatctcggccctggaatcccggggcccccagcctggcccctccgcctcctctctcctctcccagttccgcagtccttcctggcaaacagccatgcacacgccaggccccacggagctcttcatctcgggtgccctgccgggttccagcacctttccgtcctcatctgccctgtcggcttaccaacacccggcttccttcggcagccgccccttcccagtgccctcgtccctcagcctccaggaccccccattcagccctccagctaacgggctcctgtcccctcatgacgtgctgcacctgaagccctcgcaggcacccacggtgccctcttcactgggcttcgagcgcctggcagggggcggtgtcttggggccagctggtctcggtccagcccagacccccccttaccgccctggccccccagacccaccaccacctcctcgccacctcccaactcagttcaacctgctggcttcctcttccgctgccgccgccgctgccgagcagtcctccccacagctctataacttctcgggtgctgccccgggcccaccgccgcctgagcgggccctgccacgccaggacacggtcatcaagcactaccagcggccagccagtgcccagcccccaccacccccgccaccagcccatgcgctccagcactatctgagctgtggaggcagctacccctccatgggccaccgggccaacctggcctgcagccccctgggtggtggggagccctccccgggtgctggggagcctagcaaggctggtcccagcggagccacggctggggcatctggccgggccacgggccctgaggcagcagggggcggtggggctgggggtggtggtggaggttaccgccccatcattcagtcgcctgggtacaagacgggcaaaggtggttatggagcagctgccgggggtgccaccaggccccccccaccccgttcgaccgccacccccaaatgtcagagcctgggtgggccagcagccgcctatgccactgggaaggcctctggggctggaggggcagggggccaggcttattcccccggtcagcctcaagggcttctgggaccccaggcctacgggcaagggtttggaggggggcaggcacaggacttgagcaaagcccccagctactcagggggccccccacagccccccagcggcccccctcctcctggcctggccacatgtcagagctactccccggaccagctgcaggggcagctgtatggggtgcagggcgagccatacccagggccagccgcccactcccaggggctgcccacagccagcccctcgctcagctacagtaccggccattccccagcgctctcgggccatgggggtggctggggacccagctccctgggaggcggcggtgaggccagcccatctcacatcattcgtccgctccagtcaccgcctgccaccggccgtccacctggagtcggctctccaggagcccctggcaaatacctgagctcagtcttggcctcagcgcctttcctggcacctccgggagctggcagctatgcagccggagcaggtggctacaagggcaagggggatggctcggagctgctggcgggcccaggtgggcctcctgcggagcgcacagaggatgaggagttccttatccagcacctcttgcaggcgcccagccctcctcggacctcaggggcggacggcttggtgggcgaggacggggcagcagatgcctctaagggacttggggggagtggcggggccgggggaccaccgggtacaccctacgagttggccaaggaagacccccagaggtaccacctgcagagtgtcatccgcaccagtgccagcctggatgagggtgccactgcggcactggagctgggcctggggaggctgaaggagaagaagaaagggccagagcggggtggcgagacccccgaggggctggccacctctgttgtccactacggggcaggcgccaaggagctgggggccttcttgcaaaagagccctccgcccccacctcccacggcccagtctacccagcccactccccatggcctccttctggaggccgggggccctgacctcccactggtgctgcctccgcctcccccccagctgctcccctcggtcctcagccatgcccccagtccctctcccagcgcctccaaagtcggcgtccacctccttgagccagccacccgcgatggggcaccccagccacctccaccgccacccccgcctccaccacccatgcccctgcagctcgaggcccacctccgcagccatggcctggagcccgcggcccccagcccccgcctgcgacccgaggagagcctggatccgccaggcgccatgcaggaattgctcggggctctggagccgctgcccccggcgcctggggatactggcgtaggcccaccaaactcggagggcaaggatcccgcaggcgcctaccgcagccccagcccgcaaggcaccaaggcgccgcgtttcgtgccgctcacctccatctgcttccctgactccttgctccaagacgaggagcgcagcttcttccccaccatggaggagatgttcggtggaggggccgcggacgactacggcaaggccgggccacctgaggacgagggggaccccaaggctggcgctgggccaccccccggcccccctgcttatgatccctatgggccctactgtcctggccgggcgtcgggagccgggcccgagacaccgggcctgggcctggaccccaacaaaccgcctgaactgccctccacggtcaacgccgagccgctgggcctgatccagagtggcccccaccaggcggcgccaccacccccgcctccgccaccgccgcctcccgcgccggcctccgaacccaagggtggcctcacctcgcccatcttctgctctaccaagccaaagaagctgctcaagacatcctccttccacctgctgcggcgccgcgacccacccttccagacccccaagaagctgtacgcccaggagtacgagttcgaggcggacgaggacaaggccgatgttcccgccgacatccgcctcaacccccggcgcttgcctgacctggtctccagctgccgctcccgtccggccctctcgccactgggggacatcgacttctgcccacccaacccaggacccgatggcccccggcgccgtggccgcaagcccacgaaggcgaaacgtgatgggccaccccggccacgggggaggccccggatccgccccctggaggtcccgaccactgcggggcccgcctcggcctccacgcccaccgatggcgccaagaaaccccggggccggggccgaggccggggtcgaaaggctgaggaggcagggggcacccggttggagcccctgaagccacttaagatcaagctgtctgtgcccaaggctggcgagggtctgggaacctcatcgggtgatgccatatcaggcactgaccacaacagcctggactcgagcctgactcgggagaagatcgaggccaagattaaggaggtggaggagaagcagccggagatgaagtcgggtttcatggcctccttcttggacttcctcaagtcaggcaagcgccacccaccactctaccaggcgggcctgacgcctccgctcagccctcccaagagtgtgccaccctctgtgccagcccgaggcctgcagccccagccccctgccacccctgctgtgccacatcccccaccttccggagcctttgggcttgggggcgccctggaggctgcagagagtgagggtctggggcttggctgcccttcaccctgcaagcggcttgatgaggagctgaagcggaacctcgagacgctgccctccttctcctcggatgaggaagactctgtcgccaagaaccgagacctgcaggagagcatctcctccgccatctctgccctcgatgacccaccccttgctgggccaaaagacacttccaccccagatgggccgcccttggcccccgcggctgcagttccagggccaccccctcttccggggctccccagtgccaacagcaatggcactcccgagcccccgctgctggaggagaaacccccacccactccacctcctgccccgactcctcagcctcagcctccgccaccccctccgccgccacagccagccctgccctcgccacccccgctggtggcccccacgcccagctcaccaccgccaccgccgctgccgccgccacctccaccagccatgccctcgcctccaccaccacccccaccagccgctgccccactggctgctcctcctgaggagcccgccgccccgtctcccgaagaccccgagctgccggacacccggcccctgcatctggccaaaaagcaggagacggcggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaaggtgacacgtggagagcggccattgcggggtgagcgggccaccagcggacggcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatgacgagctgtacctgccccccatgcggaagatagacggcctgctgaatgagcacaagaagaaagtcctgaagcggctgtcgctaagcccagccctgcaggatgctctgcacacgttcccacagctgcaagtggagcagagtggggagggctctccggaagagggggctgtgcggctgcggcctgctggggaaccctacaaccgcaagacgctcagcaagctcaagaggagcgtggtcagagcccaggagttcaaggttgagctggaaaagtcgggatactatacactctaccattcgctccaccactataaataccacaccttcctgcgctgccgggaccagaccctggccatcgagggcggcgccgaggacctgggccaggaggaggtggtccagcagtgcatgcggaaccagccgtggctggaacagctctttgactccttcagtgacctgctggcccaagcacaggcccacagccgctgcgggtgaccccgccccagcttgtgaggggggcgcctcctccatgaaccgagaattgggacagaaccgtgtcctcaggagctaacacctgggctccatcgccggggaaagggggtcatgggtcagggtgtgtctgtgctgccccctccagggcagggttcaaagtccgactccccccctctcccaagccccctccactccctccccattcctcccactgttcggtgtacagagaaattatttatatatatgtataaatgtctatttagtaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccactgcccatcccccattgttgtctggatgtggttctattttttatcggtctcctttcccctcctccccgttctcgcccccgccccaccccctgctcccactaccctttgtctcttgctctttcttgggcttctgtacaactcaacttgtatacactgtgtacacacaaccagccaaacgaaaacccaacggcaaacacttta

SEQ ID NO: 169377 - DNA, 4479 bp, Homo sapiens
  Payload ID: 13341
  Gene Symbol: PRR12
  Gene Name: proline rich 12
  Uniprot ID: Q9ULL5
  ENST ID: ENST00000615927
  CDS Start-End: 1-3648
atggagcagctgccgggggtgccaccaggccccccccaccccgttcgaccgccacccccgcctccaccacccatgcccctgcagctcgaggcccacctccgcagccatggcctggagcccgcggcccccagcccccgcctgcgacccgaggagagcctggatccgccaggcgccatgcaggaattgctcggggctctggagccgctgcccccggcgcctggggatactggcgtaggcccaccaaactcggagggcaaggatcccgcaggcgcctaccgcagccccagcccgcaaggcaccaaggcgccgcgtttcgtgccgctcacctccatctgcttccctgactccttgctccaagacgaggagcgcagcttcttccccaccatggaggagatgttcggtggaggggccgcggacgactacggcaaggccgggccacctgaggacgagggggaccccaaggctggcgctgggccaccccccggcccccctgcttatgatccctatgggccctactgtcctggccgggcgtcgggagccgggcccgagacaccgggcctgggcctggaccccaacaaaccgcctgaactgccctccacggtcaacgccgagccgctgggcctgatccagagtggcccccaccaggcggcgccaccacccccgcctccgccaccgccgcctcccgcgccggcctccgaacccaagggtggcctcacctcgcccatcttctgctctaccaagccaaagaagctgctcaagacatcctccttccacctgctgcggcgccgcgacccacccttccagacccccaagaagctgtacgcccaggagtacgagttcgaggcggacgaggacaaggccgatgttcccgccgacatccgcctcaacccccggcgcttgcctgacctggtctccagctgccgctcccgtccggccctctcgccactgggggacatcgacttctgcccacccaacccaggacccgatggcccccggcgccgtggccgcaagcccacgaaggcgaaacgtgatgggccaccccggccacgggggaggccccggatccgccccctggaggtcccgaccactgcggggcccgcctcggcctccacgcccaccgatggcgccaagaaaccccggggccggggccgaggccggggtcgaaaggctgaggaggcagggggcacccggttggagcccctgaagccacttaagatcaagctgtctgtgcccaaggctggcgagggtctgggaacctcatcgggtgatgccatatcaggcactgaccacaacagcctggactcgagcctgactcgggagaagatcgaggccaagattaaggaggtggaggagaagcagccggagatgaagtcgggtttcatggcctccttcttggacttcctcaagtcaggcaagcgccacccaccactctaccaggcgggcctgacgcctccgctcagccctcccaagagtgtgccaccctctgtgccagcccgaggcctgcagccccagccccctgccacccctgctgtgccacatcccccaccttccggagcctttgggcttgggggcgccctggaggctgcagagagtgagggtctggggcttggctgcccttcaccctgcaagcggcttgatgaggagctgaagcggaacctcgagacgctgccctccttctcctcggatgaggaagactctgtcgccaagaaccgagacctgcaggagagcatctcctccgccatctctgccctcgatgacccaccccttgctgggccaaaagacacttccaccccagatgggccgcccttggcccccgcggctgcagttccagggccaccccctcttccggggctccccagtgccaacagcaatggcactcccgagcccccgctgctggaggagaaacccccacccactccacctcctgccccgactcctcagcctcagcctccgccaccccctccgccgccacagccagccctgccctcgccacccccgctggtggcccccacgcccagctcaccaccgccaccgccgctgccgccgccacctccaccagccatgccctcgcctccaccaccacccccaccagccgctgccccactggctgctcctcctgaggagcccgccgccccgtctcccgaagaccccgagctgccggacacccggcccctgcatctggccaaaaagcaggagacggcggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaaggtgacacgtggagagcggccattgcggggtgagcgggccaccagcggacggcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatgacgagctgtacctgccccccatgcggaagatagacggcctgctgaatgagcacaagaagaaagtcctgaagcggctgtcgctaagcccagccctgcaggatgctctgcacacgttcccacagctgcaagtggagcagagtggggagggctctccggaagagggggctgtgcggctgcggcctgctggggaaccctacaaccgcaagacgctcagcaagctcaagaggagcgtggtcagagcccaggagttcaaggttgagctggaaaagtcgggatactatacactctaccattcgctccaccactataaataccacaccttcctgcgctgccgggaccagaccctggccatcgagggcggcgccgaggacctgggccaggaggaggtggtccagcagtgcatgcggaaccagccgtggctggaacagctctttgactccttcagtgacctgctggcccaagcacaggcccacagccgctgcgggtgaccccgccccagcttgtgaggggggcgcctcctccatgaaccgagaattgggacagaaccgtgtcctcaggagctaacacctgggctccatcgccggggaaagggggtcatgggtcagggtgtgtctgtgctgccccctccagggcagggttcaaagtccgactccccccctctcccaagccccctccactccctccccattcctcccactgttcggtgtacagagaaattatttatatatatgtataaatgtctatttagtaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccactgcccatcccccattgttgtctggatgtggttctattttttatcggtctcctttcccctcctccccgttctcgcccccgccccaccccctgctcccactaccctttgtctcttgctctttcttgggcttctgtacaactcaacttgtatacactgtgtacacacaaccagccaaacgaaaacccaacggcaaacacttt

SEQ ID NO: 169378 - DNA, 927 bp, Homo sapiens
  Payload ID: 13342
  Gene Symbol: PRR13
  Gene Name: proline rich 13
  Uniprot ID: Q9NZ81
  ENST ID: ENST00000379786
  CDS Start-End: 52-348
gaacgcagcaagcccaggcggcggtggaaaggctggaggacacacctaaacatgtggaatcccaatgccggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 169379 - DNA, 1229 bp, Homo sapiens
  Payload ID: 13342
  Gene Symbol: PRR13
  Gene Name: proline rich 13
  Uniprot ID: Q9NZ81
  ENST ID: ENST00000429243
  CDS Start-End: 209-655
agagcaaccgtttcctcctcagtcggaccagagtgattgattagtttgttgtctaatcatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctgg

SEQ ID NO: 169380 - DNA, 261 bp, Homo sapiens
  Payload ID: 13342
  Gene Symbol: PRR13
  Gene Name: proline rich 13
  ENST ID: ENST00000551945
  CDS Start-End: 97-261
cgcagcaagcccaggcggcggtggaaaggtgatggggtatctggattccataggtttttccttttccccttgctaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttcccc

SEQ ID NO: 169381 - DNA, 688 bp, Homo sapiens
  Payload ID: 13342
  Gene Symbol: PRR13
  Gene Name: proline rich 13
  ENST ID: ENST00000547368
  CDS Start-End: 41-529
gaaggagaacgcagcaagcccaggcggcggtggaaaggtgatggggtatctggattccataggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaa

SEQ ID NO: 169382 - DNA, 755 bp, Homo sapiens
  Payload ID: 13342
  Gene Symbol: PRR13
  Gene Name: proline rich 13
  Uniprot ID: Q9NZ81
  ENST ID: ENST00000549135
  CDS Start-End: 53-499
tttcttatgtggaagttgtggtagttctccaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatg

SEQ ID NO: 169383 - DNA, 786 bp, Homo sapiens
  Payload ID: 13342
  Gene Symbol: PRR13
  Gene Name: proline rich 13
  ENST ID: ENST00000549740
  CDS Start-End: 67-522
cgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaaggtcagtaccctctggagactggctagggaaggagtcccccctcagagggactaggtaggcaggggttgggtgagggggattcacattctgtggacgtgagggatgacaattgtgtcgctctggtagatgattcttcctttttataaaagattgctactgggaagaatctgattatcttgaaaataaacatcaggcttctcctatctggggggagttagggtgagccttagaatggattttagaatcaaaagccaaatcttttctgccctactctcccagaacttttgctcccctcccgccaggtgcatattctagcaa

SEQ ID NO: 169384 - DNA, 838 bp, Homo sapiens
  Payload ID: 13342
  Gene Symbol: PRR13
  Gene Name: proline rich 13
  Uniprot ID: Q9NZ81
  ENST ID: ENST00000549581
  CDS Start-End: 65-361
agactgcgaaggagaacgcagcaagcccaggcggcggtggaaaggctggaggacacacctaaacatgtggaatcccaatgccggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccattt

SEQ ID NO: 169385 - DNA, 1009 bp, Homo sapiens
  Payload ID: 13342
  Gene Symbol: PRR13
  Gene Name: proline rich 13
  ENST ID: ENST00000551003
  CDS Start-End: 82-432
gtgactaggaagagccgagactgcgaaggagaacgcagcaagcccaggcggcggtggaaaggctggaggacacacctaaacatgtggaatcccaatgccggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtct

SEQ ID NO: 169386 - DNA, 625 bp, Homo sapiens
  Payload ID: 13342
  Gene Symbol: PRR13
  Gene Name: proline rich 13
  Uniprot ID: Q9NZ81
  ENST ID: ENST00000549924
  CDS Start-End: 144-590
acataattaccaattaggcagtagcagaggcgggtgccgaagcacggggtctgggtgactaggaagagccgagactgcgaaggagaacgcagcaagcccaggcggcggtggaaaggtgatggggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcacca

SEQ ID NO: 169387 - DNA, 755 bp, Homo sapiens
  Payload ID: 13342
  Gene Symbol: PRR13
  Gene Name: proline rich 13
  ENST ID: ENST00000549068
  CDS Start-End: 69-245
gccgagactgcgaaggagaacgcagcaagcccaggcggcggtggaaaggctggaggacacacctaaacatgtggaatcccaatgccgccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacatt

SEQ ID NO: 169388 - DNA, 810 bp, Homo sapiens
  Payload ID: 13342
  Gene Symbol: PRR13
  Gene Name: proline rich 13
  ENST ID: ENST00000546581
  CDS Start-End: 66-224
gagactgcgaaggagaacgcagcaagcccaggcggcggtggaaaggctggaggacacacctaaacatgtggaatcccaatgccgtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctcagctcacc

SEQ ID NO: 169389 - DNA, 2198 bp, Homo sapiens
  Payload ID: 13343
  Gene Symbol: PRR14
  Gene Name: proline rich 14
  Uniprot ID: Q9BWN1
  ENST ID: ENST00000300835
  CDS Start-End: 312-2069
gaaggaaacttctgaaccatctggtcccgggccgggggagaccgctgggcggggacgcgaggagggaaggggcgtctgtgggcgggacctcccgggattggagtgaagagggtatctgcttgacagtggatccctggggatctacgctgagttcggagatgctccagctcgggccgcccctgtctgagcggagctttgcggcgctgaagcttacaggggaaggaaaagcctcgcccggcgtctgattggcggaaccgcgctgccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaccccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctgattcttttgtatctctagctgagtttaa

SEQ ID NO: 169390 - DNA, 2316 bp, Homo sapiens
  Payload ID: 13343
  Gene Symbol: PRR14
  Gene Name: proline rich 14
  Uniprot ID: Q9BWN1
  ENST ID: ENST00000542965
  CDS Start-End: 457-2214
atggagtattgctttggagtcctcggccactcgctgggagaggaggaggatcgcagagggatccagcggaaatagcctcccaggaccgggatccccgtggatcccgggggatctcggggcataatctgcagggacaaaggcctcgggaggctcgggccgcgggagaactggggccgctgcattctgggttctggcggcaggtgccaggcagggcgcgagtgatccgctgatcgaggcggtggcagcgggaggacacccgctccgggcgaccggccgggggcgccctttcgcgccccagggctgcggccgctgggctacggggagccgcgggcggaccatgaagggcggagccccagggaaggggccggccctcaccccccgctcccccgctccccccttaccccaggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaccccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 169391 - DNA, 856 bp, Homo sapiens
  Payload ID: 13343
  Gene Symbol: PRR14
  Gene Name: proline rich 14
  ENST ID: ENST00000568754
  CDS Start-End: 129-856
gcagcgttgggtaagcttggtttttaaaggagccggaggtgggagctgcggaagacccgggatccacgggaggcggcggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtcc

SEQ ID NO: 169392 - DNA, 528 bp, Homo sapiens
  Payload ID: 13343
  Gene Symbol: PRR14
  Gene Name: proline rich 14
  ENST ID: ENST00000569864
  CDS Start-End: 215-528
ggaagacccgggatccacgggaggcggcgtggatccctggggatctacgctgagttcggagatgctccagctcgggccgcccctgtctgagcggagctttgcggcgctgaagcttacaggggaaggaaaagcctcgcccggcgtctgattggcggaaccgcgctgccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccag

SEQ ID NO: 169393 - DNA, 10826 bp, Homo sapiens
  Payload ID: 13344
  Gene Symbol: PRR14L
  Gene Name: proline rich 14-like
  Uniprot ID: Q5THK1
  ENST ID: ENST00000327423
  CDS Start-End: 191-6646
gagacgaagaggtggcggcggccggagcgcccccggcctctgtcggctccgtaggctcaggtagacctggcgacgacggggctgcagctgcaggggctgagctggctgggcaagcgcgggccgcggaggaggtctcaggggtgaatcatttgatgtaaaagacttgactccataatctgcatctgtcctaatgctgtcatctggagtagagactcagccagttccacttgattcctccatgtctgccgtggtacaggaattatactctgaactcccagtaagtgtctccagagagcttcatgctgaccctgagccaagtgtgattccagatgtaaaacctggagcctcaagctctcttttaagtcagaatagggcattgcccttggagctgcagaggactcatgtggagagttgttgtgaagaaacctatgagaccttggatcatgggagtgagcctgggcgatgtgggctagtggactccacagcaggaggttctgtggcatctgggatcttggatagggcaaagagaagcgagagcatggagccaaaggtcttcagagatccagggggccaggcaggaattataagagaaccctctgagggagcaaaggaagatccacatcaacattccacagctgctgaagaaaagactagcccgagtcaggaggatctcctgatgcagtccagcaaagaactttcacatgtggacctccctgaagattttctaaggagcaaagaaggaaatgtacagattacagctgaaactctgctaaaatccgccgaagtacaaggtatgaaggtcaatgggactaagacggataataatgaaggacacaaaaatggcaatgtgagtaaagatctctcagctggatgcggtgaattccaagaagtagacaaaatcatgaccagtgatgaggtttcagaaaccagcacattagttaccccagaacctttaacctttgtggaccctgtattaacagaagcaactcctaaagaaaaagaatgtgaagaattaaaaagttgtccttggttgtcattaccaggaaacagtgccatttctaatgtggacaatgggaaggaagagttgtgtaaaccaaacctggtctgtgaagcagatgacaatcaccaacagcttcatggccaccataatgaacaacccagttctacacatgatagtcccacagccacaagccctttgaaagaaaattctgaagtttcatgtttcacatcagacttgtctggtccagaatccagaacaatatccttagaaaactgtggttttgaaggtggtggtttgctaaagagatctgctgaaaagacagacagttcttatttttataggggggatgatcaagggaagaacttggcttctagagaagaaaatgaggaacggcttttgattcctaggagtgaaagaggtggaccttttctttttaatgccagggaaccagaaaaggagattagtggtcgttgttctggtgaaaaagagcctgttgtttctccaaaggaaaatatccacaataactgcattcaagacagtctccatacagggaactctagttctttaatgcccaattcttttactgaagccacagaagtaatgttaaataaaaatgatttgaaaattactgtacacgttcaaggtaacttgacaaaccctgaggaccataaagaaacttttactaatatgagccatcctggtggacactctgaagaaagcagtttttcctccttgatgcagattgaagaggcaggacagacaacccctgtagagcccaatatattaagtaaatctttttacactaaagactgtaactccttagtcagcatccagagaaatctggaaggcaacacccagttaaatgaagcatcatgtaatgattttctgtttgaaagaaaatccattgtgagtttaatgccagaggatcaaataagtcctgtaagtgaggtattaaaacccaagcaaggtactgctctgttgctaccatccccagaatttgattacagacctgagtcagaaaaagttatacagacctcacatgatgatattccacttttagatgaacagagcatagcctgtgagatgaatgaactttcttgtaccaatgaactggttgtaaacaaagtagaaagtgaatgtgttttaaatcaacaagtgtcccttaattctcaagaacatgcaaatttgccaactgactctctactgcatttaaacaaagagatgcctttagcaacaggcagagatgcccatcagagccatcaccctccattagagggtagagcagatgtcattgctgatatacaaaccattcccattcagacaaaaataaaagacatctctccaccaggtaaccaaacctgtggtgcctcttcaaactgtcccaccttaaacatcaaaccagtaagcctagagagaaaaaaggaaatggctgattcaggaacaaaagctctacattccaggctgcgctcaaataagagagaagcagctggctttcctcaagtggtctctgtcatagaatgtcacagcgttcaatctcaggatatctctagctgtcatcgtgtaagaaaaaatgtatcccaggaaaacatgtgttctgcttctgctgctttcaagtccagcaaaatcagcctgcaagttgataactctttgataacaaaatatgaaaatgcatttcagcaccgtgatcactgctgccaaggaacaggacactctgtggaaaaaagcagctgtaaagtgagttacacatcacaggaaagggaacttgatgggaaagaaacgaatggcagccttccaggagataagatcagaaacaaaatggtagcaggcttgttaaatagtggaatttcaaacaaaaccattcacacctccagtagcatcaaactcagtgaggaagggctggaaggaaaggagcaggatgtatccaaagaaactgtattttgtaagtataacatctctgatcatgctatacaagaactaaaccagactgtaaacattccaggtcctgaaaaagtgttggaccagtctcctactgttatgttctccagttttaaaaatgtaaaatcagttgaaacactcgatcagaaggcagatgaagtccttgactgtcagagtaaccaaaacagaccagatgaatgcaaaagtgaaggtcagtcagccaaggagatgctaagtagtgaccagagagagactgtcaccgagcctcacggggaggtaaaccacaaccaaaaggatctgctggtcagctcaggcagtaataactcactaccttgtggtagtccaaagaaatgcaatttgaaaggagcctttgtcaagatgtctggttgtgatgagtccacagaaggtatggtagacatcgtctacacggactgtagtaataagcttgcagaaggtgtgctggacgtgaaggcatctaatctactggattgtggtgcaaggcaagagaaactggcatttcaagaggactccaggagtaccttgtctcggagagaactggatgctgcacatacaggaacaactggtcaggattcagatttcccagttactgctgcttctacagtggactttctcaaaataaaaaaatcatgtgaagaaaacgtatgcagatctttaaaagactgtgaaatggaaaagtgtccagactcttgtgcccatgagatggagtctgttgcagatcatgaaccaaataaaagaatattgggcagagtaaatttgtctttaaatgatagccattatggacagcaagataaaggaacatctctcagagaaacacaagaaatgactgaaggatcaagactagaaccaaactctgagtttggcaaagaaagtacctttggaatttcctcaaaagagtcgatgtcttgccatgatgaaagctctgtttccctaagaagcctgaaatccattgaaataatgccttctcaagaaaattcagaaactaatgttaacagtgaagaaactgacctgaaaaatctttgtaaaccaaaagatggtgaaatgctttgtgaaaatgtaaaggactgcacagtccttcctgagatgaaggaaatagtatcaagagattggagtaattctagtgacagagacagcgtatgtacctgtgtggaaaagaatgcttgcaaagcttgtcaccctcacgagaattcctctgacagacatttgcctttgacagtgaaaacagatattaaagtgaaaggagaagaaaccgaagagcatcagaggggacgactgggttacttaactgttggggagcaatctgaggagttggttaccagagaaactggcgatggcgatcccgtgagcaacatctctcagacccattttaaatgccgggggatacttaatcatgctgaaaaacagcagagccctgaggttttggactacatgttgcagaaagaagagaaatatatacgtcaacaaaaagcacatacgatatcgcaacagtgcatatcatctagtctgttgttagatgatgcacaaaatcagaaccaaccgaaggctgacaaagatgagtccaccatgatcaatgaaatcaccctagcaaagctggccaaggacagcattgtggcacagactcagaagttagaagaccagaaggaggaaaggttacatcatccattaaggaaggacactgagtcatgcacaagtccttgccttcttggtgcccctcggaaagcacaagacccctcctctgctgggtgtgatcaaatacatggtgcctttgcgaagaaaggagttcttcccttaaagaagcagccccatcgaacttgtaagaaagtttcctatcaggagcaaatcattgttgggagaaaaataggtaaaatcagaagttctgcctttttaaagagttcttccaatcccatccccacaaaagcgcacagacttctcagtttgtgtactctgtctgcacctacacgattagaacctgaaacagcacctaccaagagcttggttagtcacataccaaagcagatgtctacaccgtgccatcccttgaggagcctgaattttaggaagactaccaaagaatcagccttactaaacaagctgtccatccttgcctccaaactggccccagccatgaagactcagaagctaagataccgacggtgttcctctgaacttcttccaatggctaaaagctacaagcgcctcagatataaaagactcctggacggattttcatccagcacagagcagctgaatccatatttggcagctagtggatgggataagaggcctaacagtaagcccatggcactttattctctcgaatccatcaagatgaccttcatagatttgagcaacaagatgccgtccctgctgtttggttctgaaatcttcccagtatcctttcatgtgaaatcatccagctcagattgcacgactgagtcctcaaggacttttcctgagcactgtgctccggcaaggcttgccttaggagaggccctccagtgcccgtctcaacctcccaagtggaccttttctttcttcttgtcccacggttgccctgggatggcaacattcagggaagacactggcgtccatagtcagacccacactcaggctcctccccagcctccagctcctctccaagactatggaggcactgccatagtccagaccagagcagactgctctgtccttggccttcacacacttctagcactttgttccccaggatgttaccgaatctggacaaaaaaacggagcttctccagccacatgcctaccatgcagaggctcttcatgacccagtttacacagggcctgaaagggttacggtctccagcctccatagcagacaaggtcttctgttctctgccctactcggtgggcagagtcctatccatttggagccagcatggtccttctgtctgctccttcgaaatctcttctcttcattcccctcactgcaagcggcaaccaagtctgggcaccacaagcagccacaccatgttaccatatgtgcctcttccaggcatggaagctacatataacaccagcggcagtcagacgaggctggagcctccattccctgccttggtaccaaagtcttgcttggtagcagaatcagctgtcagcaagctcctgctttcagcctctgagttccaggttcgtggattggatgagctggatggtgtgaaagcagcatgcccctgcccacagagcagccccccagaacagaaagaggctgagccagagaagaggccaaagaaagtctcacagattcgcatccggaaaaccattcctaggccagatcctaatcttacccccatgggccttcctcgacccaaaaggttaaagaagaaggagtttagtttagaagagatatataccaacaagaattataaatctcctcctgcaaacaggtgtttagagaccatctttgaggaacccaaggaacgaaatggtacactaatctcaatcagccaacagaagaggaagcgagttctagaatttcaggattttacagtcccgcgaaagaggagagctcgaggcaaagtcaaggtggcaggcagctttaccagggcccagaaggcagctgtgcagagtcgagagctggatgctcttttgatacagaaactaatggaactggagaccttctttgccaaggaagaggagcaggaacaatcatcaggctgttgagaagcgattcagtttgagggtctcaattttagggtttttttgttttgttttgtttttgggttttttttttttttttggacctccttggaaaaggttgcctaattttgccctaccgccaaaccactcaaaaatgcacagtccatgaatttttacctatttcaaggtgcaacctttttagaaactggtgaaggagggtcctctacttttactgctgagtatagaacctcaggaatgctccctttctcctggaaatggacctgaacgacatccagccacctcctcagtctctgccatccacaggaggaagcagcagcctatcttcagtaacactaggattccaaggacacacaggatttgcacgtccatatgaaagttccgctttgtttacggtggtgctagaccaagattattagaaacgtggcctagggagggggacctggcgtcctgtcctgtgtggtctcactggctcatttcagtagttgaggaaagatgagctgttgtgttttcttatcttttgtctgcccaggacctattgatgtgagtgtatgtgagagtgtttgtgtgtgtgtggctttttcccatcgttttctcccctctgtgactgggtcactagtgccagaggagcccgtccaggccccattcgaagtaagttgcactttttaatgttgtggtgtggattattttcatttgttttattttcttttttgttgttgtttttgtactattattgctgcatgtgtggagcctttaaatgtgattttaaaacatttttttaaggagaaaaacaatacatgtcttaagaatacatgataggcatttgacccagttgatcgctgcatggaagagacatttttcctattcatgtgtttcaggcaatcccttccccatctccagcttctagtgtaactcattagagggagcactttttttcatctgggttctcattcttgcccaccaaatacatgtatttattttagtgatttaagtaagagcaggtttctctcccgatcattgaaaaactactatggttgggtgtggtcttaatggtttttatctgaaatggtgttaggtaacaaaattgagtacaacggcttgggcagtgatacaggctgacccacagtatttgtggctttccaggcagcccgcttcaagtgtggggagagagtcggggtcatgtttcagacccagagatgtgttcctgcagtgggatctcaaaaatccccagccagccttctttgagggccacctcattgtactctgggctcctacgtcacatctaccggaactgtcaaatgctggagttagccgagtttctgggtttgtgcctgcaggagtctgtgggcagagggatgctgtgggtcagcagcctcgaggtcttgttccttttccactgaagtcctgtgtgtccatatcctgctccccttcccctccttctctaggggtttctctttctctctcaaaacaagagtttagagaattaacattccatggctagtgagtgggatgcaaaagtcatcgtcaggacaccagcatcacctcttcatatcctcctgggagccactggcatggagcagccgccgatgggaaccgtcagagttctagggacatttccaagtcagtctattagagaagagtgagtggcacgtcctggaatgttggccaactctcctaggtttcttttgcttccccatttgctagtggatggggagatgggttgggggtggggggtctctatgtgccttgcttttgcaggttgacagtctatgccacactggagcagaaaaactgacatgagccagagggaaaagtgtgccacggctatgttctaggcccactgcctcagacatagcattgagacgagtgaaatacacacttggtcatccacggaggcttccaaggccatggccaaatacagttagaagagagccaggcttccgtaccagctctgaatgatgctaaccagattctgtcattctacatccactttgcccagactgtatagacacgacctatgtttcacctcaatacctctcccttcctgggacagggttcttagacactaaatgcttctctctgacttttttgcttaagggagtgggatgagtagtacattttgcccttgtccaggcatgtttaaggagctcctactggacaggttgcagactagcagtgagtcaacagagccctgtttgccagctctgttgccagtatagatgcagtgatgtggcggctatgtttcccagagacaacagtgggcacagctatagtgtcaccaacatggcagagatagtttcaactgtgcctgttacaggtgtggcactcgaaggaccagaagcagcggtttggaacatgggtaactgggagcagaggactggaagaaacagagctgggctccttccctgtcctgacaatgtaggagaggagttgttgtgaggccagccctgcccgtcgttgaaattctggacctaccctctagctaggtcccttcccctgctccaaagttgagaagggggccccactgcaaacttgaaattacttacctgaaggtgatgtatatacctaggctccagctgcgctcagccacacctgtcttaacattcagtttcggcactgagccagctgcagtgttgtcaggggtccccaggcccgtggtccctaaccacgatgggacatggtaatcggctgctggcacaccacctgcccagagctacaggaggtctggttctggggtggagttggtacagtttctgagtatgggaacttccctccccaagtggtgggaagttacagttaactacagcttactcaactatcacttccagaggtttagtgtttttaatatgggaaagaggagaaatctcaggtctaatcagggttctgcccatcagcttttcactgaaactttcaactgtgttttgttttttgtttttttttccatctttcagtttctagctgtgtttgccttctccctccgcgttccctcctctttttttgcttttggtctcctttccagcttcatgtctccatgagttcagctgtacctcatctcctgttaaagcagatcatgtccactttttcttactgaccttactctaagctacagtagctgagggaggtacggtgaagacatgtagcgtttgccttattcggagcctgaggagcccagaaacccatgctgtgaatcccaaaactcagcgctcctcaagagctgtgaaaatcatgatactttgtcacaattttgcctgaaagggtctttggcacgggctccagagccaacctgaggtccattccagatcccactatctgggcgtgagacctcccccgtggctccttccttgcccactgagccaagagcagcagggagcgtacaggacgggagcagcagatccaaggccgcggtgcagccaatgaatgcacggccgtcgctccgtctccaggctggaattccgtctcataatcaatgccatgtacattaagatctgcgaaagaccaacttttaggcagtgatacttttctcccattccctggggtggggggagtatgcagttggtgctttctgtaattcccttgttctgttttgtttctgtaagcttttcccctggtgtcatggaaaggacttcttaaataaccacattgtgggtggctgtatccaaagtttaaataattggccagaagtgcagagtatcctttcctggattcgtgtcagaaaagggctccttgccacaactgaacttactgtataaaaacctggctagggagatttaattttactaaaattacagtttaatgttaccgtctagccacaaatcaagcagcaaaagctattttgatgatgaaagggggtccccgttgagctggccatctagtgcagtgtgctctcagattccatgtttgttgattgtgtgtcttcacaagcccctctctggtgctgaattggatttgaattcttggtgagaggcctcagcatctccttgggctggtctgggccagtaaaaatagctgcctgacatgtttatatattatcatggtcagtagttcaatgaaatttgtacatttttggtaacattggtatacatgatgcccctgcagttccttttctgtttggtagtttgtgactctaagatttccactgttatgtgtgttaatttatgaaaataaatttttttgaaaacctttcaaa

SEQ ID NO: 169394 - DNA, 1849 bp, Homo sapiens
  Payload ID: 13344
  Gene Symbol: PRR14L
  Gene Name: proline rich 14-like
  ENST ID: ENST00000330495
  CDS Start-End: 1-1357
gaccttcatagatttgagcaacaagatgccgtccctgctgtttggttctgaaatcttcccagtatcctttcatgtgaaatcatccagctcagattgcacgactgagtcctcaaggacttttcctgagcactgtgctccggcaaggcttgccttaggagaggccctccagtgcccgtctcaacctcccaagtggaccttttctttcttcttgtcccacggttgccctgggatggcaacattcagggaagacactggcgtccatagtcagacccacactcaggctcctccccagcctccagctcctctccaagactatggaggcactgccatagtccagaccagagcagactgctctgtccttggccttcacacacttctagcactttgttccccaggatgttaccgaatctggacaaaaaaacggagcttctccagccacatgcctaccatgcagaggctcttcatgacccagtttacacagggcctgaaagggttacggtctccagcctccatagcagacaaggtcttctgttctctgccctactcggtgggcagagtcctatccatttggagccagcatggtccttctgtctgctccttcgaaatctcttctcttcattcccctcactgcaagcggcaaccaagtctgggcaccacaagcagccacaccatgttaccatatgtgcctcttccaggcatggaagctacatataacaccagcggcagtcagacgaggctggagcctccattccctgccttggtaccaaagtcttgcttggtagcagaatcagctgtcagcaagctcctgctttcagcctctgagttccaggttcgtggattggatgagctggatggtgtgaaagcagcatgcccctgcccacagagcagccccccagaacagaaagaggctgagccagagaagaggccaaagaaagtctcacagattcgcatccggaaaaccattcctaggccagatcctaatcttacccccatgggccttcctcgacccaaaaggttaaagaagaaggagtttagtttagaagagatatataccaacaagaattataaatctcctcctgcaaacagggacctggattctagctgcccgagcactgacagcgaaaccgggcacttcctggtattcggatatgcgcagcgccaagcgcagccgcacccactgctggcctcacgccgtctgattggctgcagctctccggaggggcggggccatccgagaagctatccatattggaggaggctgctagtcctttgctggtacctgccgggctggagagcggggagggtcacgtggttaagactcgccacgtgggccgggcgcggtgactcaagcctgtaatcccagcactttgggaggcagaggcgggcggatcacttgagacaggcctggccaacctggtgactctactaaaaatacaaaaaattagccgggagtggtggcgcgcgcctgtaatcccagctactcgggaagctgaggcagaagaatcgcttgaactcgggagactgtaggtgccgtgagccgaggtcgcgccactgcactccagcctgggagaaagactcgcctaagcagtttctctcttttcttttgcatttttaatcttagacttttggagatgttgaaatggtcgctgaaacactgcaaacacagggatgggggacagatcccaaagtatagcagctactcatgagtcccagcgcccctcctgtccttcccctactgctgcctaagtggtcttcctaaaacacaagtttgcacttgtcagaaccactccttaagatctctcatgggttgccctcgtctccaaataaagatactaaccactgagctggc

SEQ ID NO: 169395 - DNA, 2841 bp, Homo sapiens
  Payload ID: 13344
  Gene Symbol: PRR14L
  Gene Name: proline rich 14-like
  ENST ID: ENST00000431684
  CDS Start-End: 1-2028
aaagtgaaaggagaagaaaccgaagagcatcagaggggacgactgggttacttaactgttggggagcaatctgaggagttggttaccagagaaactggcgatggcgatcccgtgagcaacatctctcagacccattttaaatgccgggggatacttaatcatgctgaaaaacagcagagccctgaggttttggactacatgttgcagaaagaagagaaatatatacgtcaacaaaaagcacatacgatatcgcaacagtgcatatcatctagtctgttgttagatgatgcacaaaatcagaaccaaccgaaggctgacaaagatgagtccaccatgatcaatgaaatcaccctagcaaagctggccaaggacagcattgtggcacagactcagaagttagaagaccagaaggaggaaaggttacatcatccattaaggaaggacactgagtcatgcacaagtccttgccttcttggtgcccctcggaaagcacaagacccctcctctgctgggtgtgatcaaatacatggtgcctttgcgaagaaaggagttcttcccttaaagaagcagccccatcgaacttgtaagaaagtttcctatcaggagcaaatcattgttgggagaaaaataggtaaaatcagaagttctgcctttttaaagagttcttccaatcccatccccacaaaagcgcacagacttctcagtttgtgtactctgtctgcacctacacgattagaacctgaaacagcacctaccaagagcttggttagtcacataccaaagcagatgtctacaccgtgccatcccttgaggagcctgaattttaggaagactaccaaagaatcagccttactaaacaagctgtccatccttgcctccaaactggccccagccatgaagactcagaagctaagataccgacggtgttcctctgaacttcttccaatggctaaaagctacaagcgcctcagatataaaagactcctggacggattttcatccagcacagagcagctgaatccatatttggcagctagtggatgggataagaggcctaacagtaagcccatggcactttattctctcgaatccatcaagatgaccttcatagatttgagcaacaagatgccgtccctgctgtttggttctgaaatcttcccagtatcctttcatgtgaaatcatccagctcagattgcacgactgagtcctcaaggacttttcctgagcactgtgctccggcaaggcttgccttaggagaggccctccagtgcccgtctcaacctcccaagtggaccttttctttcttcttgtcccacggttgccctgggatggcaacattcagggaagacactggcgtccatagtcagacccacactcaggctcctccccagcctccagctcctctccaagactatggaggcactgccatagtccagaccagagcagactgctctgtccttggccttcacacacttctagcactttgttccccaggatgttaccgaatctggacaaaaaaacggagcttctccagccacatgcctaccatgcagaggctcttcatgacccagtttacacagggcctgaaagggttacggtctccagcctccatagcagacaaggtcttctgttctctgccctactcggtgggcagagtcctatccatttggagccagcatggtccttctgtctgctccttcgaaatctcttctcttcattcccctcactgcaagcggcaaccaagtctgggcaccacaagcagccacaccatgttaccatatgtgcctcttccaggcatggaagctacatataacaccagcggcagtcagacgaggctggagcctccattccctgccttggtaccaaagtcttgcttggtagcagaatcagctgtcagcaagctcctgctttcagcctctgagttccaggttcgtggattggatgagctggatggtgtgaaagcagcatgcccctgcccacagagcagccccccagaacagaaagaggttaaagaagaaggagtttagtttagaagagatatataccaacaagaattataaatctcctcctgcaaacaggtgtttagagaccatctttgaggaacccaaggaacgaaatggtacactaatctcaatcagccaacagaagaggaagcgagttctagaatttcaggattttacagtcccgcgaaagaggagagctcgaggcaaagtcaaggtggcaggcagctttaccagggcccagaaggcagctgtgcagagtcgagagctggatgctcttttgatacagaaactaatggaactggagaccttctttgccaaggaagaggagcaggaacaatcatcaggctgttgagaagcgattcagtttgagggtctcaattttagggtttttttgttttgttttgtttttgggttttttttttttttttggacctccttggaaaaggttgcctaattttgccctaccgccaaaccactcaaaaatgcacagtccatgaatttttacctatttcaaggtgcaacctttttagaaactggtgaaggagggtcctctacttttactgctgagtatagaacctcaggaatgctccctttctcctggaaatggacctgaacgacatccagccacctcctcagtctctgccatccacaggaggaagcagcagcctatcttcagtaacactaggattccaaggacacacaggatttgcacgtccatatgaaagttccgctttgtttacggtggtgctagaccaagattattagaaacgtggcctagggagggggacctggcgtcctgtcctgtgtggtctcactggctcatttcagtagttgagg

SEQ ID NO: 169396 - DNA, 3308 bp, Homo sapiens
  Payload ID: 13344
  Gene Symbol: PRR14L
  Gene Name: proline rich 14-like
  ENST ID: ENST00000432485
  CDS Start-End: 1-625
ggagcctccattccctgccttggtaccaaagtcttgcttggtagcagaatcagctgtcagcaagctcctgctttcagcctctgagttccaggttcgtggattggatgagctggatggtgtgaaagcagcatgcccctgcccacagagcagccccccagaacagaaagaggctgagccagagaagaggccaaagaaagtctcacagattcgcatccggaaaaccattcctaggccagatcctaatcttacccccatgggccttcctcgacccaaaaggttaaagaagaaggagtttagtttagaagagatatataccaacaagaattataaatctcctcctgcaaacaggtgtttagagaccatctttgaggaacccaaggaacgaaatggtacactaatctcaatcagccaacagaagaggaagcgagttctagaatttcaggattttacagtcccgcgaaagaggagagctcgaggcaaagtcaaggtggcaggcagctttaccagggcccagaaggcagctgtgcagagtcgagagctggatgctcttttgatacagaaactaatggaactggagaccttctttgccaaggaagaggagcaggaacaatcatcaggctgttgagaagcgattcagtttgagggtctcaattttagggtttttttgttttgttttgtttttgggttttttttttttttttggacctccttggaaaaggttgcctaattttgccctaccgccaaaccactcaaaaatgcacagtccatgaatttttacctatttcaaggtgcaacctttttagaaactggtgaaggagggtcctctacttttactgctgagtatagaacctcaggaatgctccctttctcctggaaatggacctgaacgacatccagccacctcctcagtctctgccatccacaggaggaagcagcagcctatcttcagtaacactaggattccaaggacacacaggatttgcacgtccatatgaaagttccgctttgtttacggtggtgctagaccaagattattagaaacgtggcctagggagggggacctggcgtcctgtcctgtgtggtctcactggctcatttcagtagttgaggaaagatgagctgttgtgttttcttatcttttgtctgcccaggacctattgatgtgagtgtatgtgagagtgtttgtgtgtgtgtggctttttcccatcgttttctcccctctgtgactgggtcactagtgccagaggagcccgtccaggccccattcgaagtaagttgcactttttaatgttgtggtgtggattattttcatttgttttattttcttttttgttgttgtttttgtactattattgctgcatgtgtggagcctttaaatgtgattttaaaacatttttttaaggagaaaaacaatacatgtcttaagaatacatgataggcatttgacccagttgatcgctgcatggaagagacatttttcctattcatgtgtttcaggcaatcccttccccatctccagcttctagtgtaactcattagagggagcactttttttcatctgggttctcattcttgcccaccaaatacatgtatttattttagtgatttaagtaagagcaggtttctctcccgatcattgaaaaactactatggttgggtgtggtcttaatggtttttatctgaaatggtgttaggtaacaaaattgagtacaacggcttgggcagtgatacaggctgacccacagtatttgtggctttccaggcagcccgcttcaagtgtggggagagagtcggggtcatgtttcagacccagagatgtgttcctgcagtgggatctcaaaaatccccagccagccttctttgagggccacctcattgtactctgggctcctacgtcacatctaccggaactgtcaaatgctggagttagccgagtttctgggtttgtgcctgcaggagtctgtgggcagagggatgctgtgggtcagcagcctcgaggtcttgttccttttccactgaagtcctgtgtgtccatatcctgctccccttcccctccttctctaggggtttctctttctctctcaaaacaagagtttagagaattaacattccatggctagtgagtgggatgcaaaagtcatcgtcaggacaccagcatcacctcttcatatcctcctgggagccactggcatggagcagccgccgatgggaaccgtcagagttctagggacatttccaagtcagtctattagagaagagtgagtggcacgtcctggaatgttggccaactctcctaggtttcttttgcttccccatttgctagtggatggggagatgggttgggggtggggggtctctatgtgccttgcttttgcaggttgacagtctatgccacactggagcagaaaaactgacatgagccagagggaaaagtgtgccacggctatgttctaggcccactgcctcagacatagcattgagacgagtgaaatacacacttggtcatccacggaggcttccaaggccgcggtgcagccaatgaatgcacggccgtcgctccgtctccaggctggaattccgtctcataatcaatgccatgtacattaagatctgcgaaagaccaacttttaggcagtgatacttttctcccattccctggggtggggggagtatgcagttggtgctttctgtaattcccttgttctgttttgtttctgtaagcttttcccctggtgtcatggaaaggacttcttaaataaccacattgtgggtggctgtatccaaagtttaaataattggccagaagtgcagagtatcctttcctggattcgtgtcagaaaagggctccttgccacaactgaacttactgtataaaaacctggctagggagatttaattttactaaaattacagtttaatgttaccgtctagccacaaatcaagcagcaaaagctattttgatgatgaaagggggtccccgttgagctggccatctagtgcagtgtgctctcagattccatgtttgttgattgtgtgtcttcacaagcccctctctggtgctgaattggatttgaattcttggtgagaggcctcagcatctccttgggctggtctgggccagtaaaaatagctgcctgacatgtttatatattatcatggtcagtagttcaatgaaatttgtacatttttggtaacattggtatacatgatgcccctgcagttccttttctgtttggtagtttgtgactctaagatttccactgttatgtgtgttaatttatgaaaataaatttttttgaaaacctttc

SEQ ID NO: 169397 - DNA, 661 bp, Homo sapiens
  Payload ID: 13344
  Gene Symbol: PRR14L
  Gene Name: proline rich 14-like
  ENST ID: ENST00000412743
  CDS Start-End: 121-661
gggaccatagagacgaagaggtggcggcggccggagcgcccccggcctctgtcggctccgtaggctcagggtgaatcatttgatgtaaaagacttgactccataatctgcatctgtcctaatgctgtcatctggagtagagactcagccagttccacttgattcctccatgtctgccgtggtacaggaattatactctgaactcccagtaagtgtctccagagagcttcatgctgaccctgagccaagtgtgattccagatgtaaaacctggagcctcaagctctcttttaagtcagaatagggcattgcccttggagctgcagaggactcatgtggagagttgttgtgaagaaacctatgagaccttggatcatgggagtgagcctgggcgatgtgggctagtggactccacagcaggaggttctgtggcatctgggatcttggatagggcaaagagaagcgagagcatggagccaaaggtcttcagagatccagggggccaggcaggaattataagagaaccctctgagggagcaaaggaagatccacatcaacattccacagctgctgaagaaaagactagcccgagtcaggaggatctcctgatgcagtccagcaaagaactttcacatgtggacctccctgaagattttctaagga

SEQ ID NO: 169398 - DNA, 1678 bp, Homo sapiens
  Payload ID: 13345
  Gene Symbol: PRR15
  Gene Name: proline rich 15
  Uniprot ID: Q8IV56
  ENST ID: ENST00000319694
  CDS Start-End: 713-1102
gtggcagcggtgaccgcctcctgggttattttcttttctcccccagctgccccagggttctggtttcccgaatcacttggcaaataaccagcaggtgggcagatgtcttttttgcgttcctacggacgcgtaggcaagttcgatgcgccggagtgaacagccagggtcccatctctcagccggctcccgggcggtgctagcagggaagagggacgcgccggcgaatgaaacactactagcccggaaagccgccctggaccttccacccgggcagcgagtctggcggcccctcgccgccgccccctccgaccagaacagactgcgctgcgagccccgggcttccgccgcagcgcgcagcaattggaggtgccagaggagaccagcagcagcacttgatttagctgggctgcgggaattccgacctgtacactttccagaagcctgatctctccaagtccgcgcccagggactcgagccccggcttccaggttgacccgagcgcgcccccttcgtgctctcggccgcgttcaccgcgcgaggcctccgggtcctgttaagcccgagcagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctccggcccctggtggaaatcgctcaccaacagcagaaagaaaagcaaggaagccgcagtgggggtgccgcctcccgcccagcccgctcccggggagcccacgccacctgcgccgcccagcccggactggaccagcagctcccgggagaaccagcaccccaatctcctcgggggcgccggcgagccccccaaaccagacaagttatacggggacaaatccggcagcagccgccgcaatttgaagatctcgcgctccggccgctttaaggagaagaggaaagtgcgcgccacgctgctcccggaggcgggcaggtccccggaggaggcaggctttcctggtgacccccacgaggacaagcagtagccccaatagcctgcgcgctccaggactgcctacccagcactaccccaaacccccagttccaaacccgagacttcaggcccgcccccttacgcgttgtctcattccaccaaattcagaatatttacacaatgccttcatgattttatttttctggaaattgaagtgtcaattgggttctcaatatttcatgactccaaggatgcattaaatatttatttgtggtaagagaagatacctgccgcggaggagggtggcataattatttttttttcaaaaagctattctggggccctggccccctggctcctgtcacagctcagcttgaactctgtagcctctcaaatgaagaaggtggctgttatttaggactctgtggaaagcaaatcacagtgctgtttttaatgcctgagaaatgcactttaggggtagacttataccttaagtgaaggagtgggggaggaagaagcattcttaagtagaagcattttaaaataaggcaggattgcttttaatgttaaactacaaaactgtacagcctattttagtgtggactattaaaacccttgcactgtaagg

SEQ ID NO: 169399 - DNA, 503 bp, Homo sapiens
  Payload ID: 13345
  Gene Symbol: PRR15
  Gene Name: proline rich 15
  ENST ID: ENST00000450427
  CDS Start-End: 450-503
agtaaaaggaagaattaggatggcggttttcaagggaagttaagtctagacatgcttctttgaaagtcacaaggcagaagtggtcaaaagtagaatttaaaagaaccaaaacaaatatcataagcttgtccttctctcctactgggatataaattctcctaagtatctcatcgaaaaggctcctgggacgaaagtcgatgggggcaaatcttggagggaaatttcgtgactgtttgaccatggactaattaataccgttcacctgtagagaggatgcacttggttcccagcgccctcctcccagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctccggcccctggtggaaatcgctcacc

SEQ ID NO: 169400 - DNA, 1519 bp, Homo sapiens
  Payload ID: 13346
  Gene Symbol: PRR15L
  Gene Name: proline rich 15-like
  Uniprot ID: Q9BU68
  ENST ID: ENST00000300557
  CDS Start-End: 252-563
gactccaggagctgcagcagagcaggtaacagctcttgcacctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgaggagggtgctagcacctcttggctccctgccatcagccagatctgagacaggaccttgccacgctggcctctttggccatagctgaagctgtggggccagttgatacctgctggcaggaaatggctgttttttaggtttgtatttatgtgccgccacttttgtaaggcctgggagatcccagggtcctccaccctccccctgaccacatacaaaggcactctagttcaagagtgaaaagtctcacccaggaggaacagccctccttgaagcaatggcagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacgtgataggggctggtttctgtggagccagaggcagagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctcaaa

SEQ ID NO: 169401 - DNA, 1826 bp, Homo sapiens
  Payload ID: 13347
  Gene Symbol: PRR16
  Gene Name: proline rich 16
  Uniprot ID: Q569H4
  ENST ID: ENST00000379551
  CDS Start-End: 358-1203
gccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggagatgaagtcccactctgttgcccaggctagagtgcaatggcacaatctgggctcactgcaacctctgcctcccaggttcaagctattctcctgcctcagcctgcctcagtgcgccactacgcctgggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaatatgaatgatgcattgtttttgcaattgacctatgacaaactgtgaacctgcagatttcacctattttgatttactataagagctgggatttgattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtggaaatattgttaaatcaataaacaatagtaaataatgacaaaagcaaatgttcctcagaattaaaa

SEQ ID NO: 169402 - DNA, 1747 bp, Homo sapiens
  Payload ID: 13347
  Gene Symbol: PRR16
  Gene Name: proline rich 16
  Uniprot ID: Q569H4
  ENST ID: ENST00000407149
  CDS Start-End: 210-1124
gagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaatatgaatgatgcattgtttttgcaattgacctatgacaaactgtgaacctgcagatttcacctattttgatttactataagagctgggatttgattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtggaaatattgttaaatcaataaacaatagtaaataatgacaaaagcaaatgttcctcagaattaaaa

SEQ ID NO: 169403 - DNA, 1152 bp, Homo sapiens
  Payload ID: 13347
  Gene Symbol: PRR16
  Gene Name: proline rich 16
  ENST ID: ENST00000446965
  CDS Start-End: 181-936
ggaaacagtgctgcaggcatacagtgacaacaggacatcaggaaatgcccaagaagtttgttaggtgctgtgtcatgaatcaagtcttcattttaatgtgttctaattgttgtaaaacaagagggaatggtatttggaatttagctatatttatcttctcaatcaaattctacttcagaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatg

SEQ ID NO: 169404 - DNA, 559 bp, Homo sapiens
  Payload ID: 13347
  Gene Symbol: PRR16
  Gene Name: proline rich 16
  ENST ID: ENST00000509923
  CDS Start-End: 133-559
ggctgccggcggcgtcgcggagctggtagcagagtcccagcgcgccgctcactactgaatggggtcctggtgcggttctcggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagt

SEQ ID NO: 169405 - DNA, 1298 bp, Homo sapiens
  Payload ID: 13347
  Gene Symbol: PRR16
  Gene Name: proline rich 16
  Uniprot ID: Q569H4
  ENST ID: ENST00000505123
  CDS Start-End: 373-1077
agcatgtctggtatccagcttttaatccgtaatgccaggcactcccaaataaaaggaaccaatcaactgatgcatgcattctctagcaggtcattccagaagctccattacctactcccacctccccacatgatgaaacagggaaacagtgctgcaggcatacagtgacaacaggacatcaggaaatgcccaagaagtttgttaggtgctgtgtcatgaatcaagtcttcattttaatgtgttctaattgttgtaaaacaagagggaatggtatttggaatttagctatatttatcttctcaatcaaattctacttcagaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaa

SEQ ID NO: 169406 - DNA, 3084 bp, Homo sapiens
  Payload ID: 13348
  Gene Symbol: PRR18
  Gene Name: proline rich 18
  Uniprot ID: Q8N4B5
  ENST ID: ENST00000322583
  CDS Start-End: 242-1129
gcgggaggcggttcctgcagggtccagtcccgggagcacccccaggaggaggggagggtgggagcgcctctctttgagtccccgggtttggtcgctgggatgtgaggaagccggagaggccgcggctggacgcaggtgggtgtggaggggccgcccggactgcggggacccgctccgcgcacagtggctgagcgcccgcctctctttccaggggctgaggatccggcggctcggctgcactatgcccttcccgcccatgccgccgccgcccgcccccgccccgggggcccaagccgcgcgccagttaccccggaggccctgcgccgcgggggacaagaagaagaggcccccacagcggcccgaggggctcctctccagctcctggccctccgccacgctcaagaggccgccggcccggcgcggccccggcctggacaggacgcagccgccggcccctccgggcgtctccccccaggccttgcccagccgcgcgcgggccccagccacgtgcgccccgccccggccggcaggctccggccacagcccagcgaggaccacctatgcggcgacctcggcggggacggggaccaccgccgcgggcacctcctcgggggcggggccttgtccagactccgctgcgcgcttctgcctgaatctcacccccgaggccgtcctggtcatccagaagcgtcatctggagaagcagctgctggcgcggccccgcaggcccttcccctcaccctcggccgaacccaggcgcctactcgccccgtgtctcccggctagggccgcgggcccgcggaggggcggccccgccagcgaccccgacgcaccccccaccgccggccagggccgccgcgcgcctccgcccggcgcccagctgctgcacggcggcctgcaggttccccagctcagcccgcggcccggggccctgcggccgatgctcaaggtgtcgctgctcaacgagcggcacaggtacgacgacgtggagtacgaggaggagccagaggcggtggacgagggcctggtacgcaagtgcacggagtggctgcgcggcgtggagtccgcggctgccgcgcggggccgggcgggggccctggactcacggcggcacctgagcacgctgtgagcccagcgggcctgcggggacaggccaggcctgatcccacctcacttcctgcacgcgccactccgcctaggggccctcgggggagaccgcaggctcctctggccgccagcgcccactttcgggacaccagtgcgcaagctggcccacgtggggcgcagccagactcgcccgacggccacggcccccctcctgccctcgccagccggcagcccgggcctttctcgttcacaccggtggtatctaccccagatgcctgcctctgcccccactctggcctcctcttggcatcgccgagcatccatgcagttcgtggggaattaagcaactgagaaaatgcctcttggtgccccgacccccagggttcgtctaggtcccagagaccctctgcctggaggcgggccttccccagggctacatctgcacgccccgtggtgtcaccctcagccggcgccgggcaccctggacagtgcggtgggcgatggcccaggtgggtggccgcgacggtggcctcctgcagagctgggacccggtcctacattcgtgattttgttttctcccaagtcagaaaaatgttgagggtattagacatccctgaaactcagttaaccgaatttccagtctccaaagcggaagggtaggcatcgccaggcgctggtgagccctggtcaatgagcgcttccatggaaaccgctcggctgattacattttttctgtgtattatttgaatagagagtaaagctcctccgctgtttcgtaaccatatcctttcccccgctaactggaggctgatttctacatatttcttccatgtatctgagaatatctaactagaaggatgagaaggaaataaaatgttataatcagataaggctggttataaaagagtaatgtattacctcaatttttgactgactttgtaaaagccaataactggtttaatgtttatcttgatagactttaaatgtatcaagtcttaattgtattttaaattgaagccttacatttttaaaacagattttgtatttttcttgtggaggtctttgctctaataacacacacacactgtctctctctctctctctctctaattctaggcacacatttagttagatgtgaagcatttaattcattgggagctaggtcagctgccagatgagttgcaaaaacagaaaaaaacctacccattgaataacttctttgaatttggagataagttttcttttacttaaaatgaatatattaattctagaggggcaaaactagcaatgcttatgcaagtgacggtgctgctcttgttccacccccacccagatggtctctgagtgcgccgtcctgggcagggcacacggtctggagctgagagggtggagcaagagtgcactgactccgagccgagggcaggagtggctcaacttggtctcgtcttgcacttagtgcaaataccaataattaagatgcctagacttctgcccttggtcacagtaacaacaacattttgaagacttttccctggtggcatcctagagggaccgactttctgcagcctctgtcttccaagctgagcttctgctgcagtgtggctgtcactgcacctgtgtgtctccctgacgtccctgtcagctgcttcattttgatttcctttcttctcccgccctttctgtaggctctgtcccagcatctcctgttcttaactggccacaatacaacactaagcgcatttttagtaatttgtatttattaaatagagtttgtgggccttgttctctactttaaaagcagatgagtggaacatttatgtttccctggtcaatgagcttcaataaaaaacaaacagaaaaaaggttttacacgtgacacatgatatcttttcattgctgttaaggacattttgagaaagttttctaagtcgctatgctccaatttcttaatgcttaaataaaagagaaattcagtga

SEQ ID NO: 169407 - DNA, 580 bp, Homo sapiens
  Payload ID: 13348
  Gene Symbol: PRR18
  Gene Name: proline rich 18
  ENST ID: ENST00000529616
  CDS Start-End: 231-580
gccggcccggcccgcgtctcagctgtggggacccgggggcgccgcgactcgcccacagtcggacggcgggaggcggttcctgcagggtccagtcccgggagcacccccaggaggaggggagggtgggagcgcctctctttgagtccccgggtttggtcgctgggatgtgaggaagccggagaggccgcggctggacgcaggggctgaggatccggcggctcggctgcactatgcccttcccgcccatgccgccgccgcccgcccccgccccgggggcccaagccgcgcgccagttaccccggaggccctgcgccgcgggggacaagaagaagaggcccccacagcggcccgaggggctcctctccagctcctggccctccgccacgctcaagaggccgccggcccggcgcggccccggcctggacaggacgcagccgccggcccctccgggcgtctccccccaggccttgcccagccgcgcgcgggccccagccacgtgcgccccgccccggccggcaggctccggccacagcccagcgaggaccacctatgcggcgacctcggcggggacggggaccac

SEQ ID NO: 169408 - DNA, 1530 bp, Homo sapiens
  Payload ID: 13349
  Gene Symbol: PRR19
  Gene Name: proline rich 19
  Uniprot ID: A6NJB7
  ENST ID: ENST00000341747
  CDS Start-End: 379-1449
agtttcccaatcaggtagtgagagtggcacgaaccagccgttctcctgagccaccccccgcgcccccggactcctcaatatcccaggtgggaacgctcaccagggacatccagcgcccgtcgccctgtacgtcctgcaccggcgtgggcttgctggctgggttctcctctccactcatcttggcgccgcagctcctgcaggatgagcgagtcgggtcggcccgggagtgttccgaacggagctggctccgccacgcccactcctacccctcgcggcaacaaaggaccgtcccaacgctagcacacccgcggaggacgaaggccgatacagggcgccgcctcctctccagggacggaagccttcacttaggaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctgaggctagggctggggacagatatcttgtactcccagtgacctcaataaagtacttttcatggtcctcttga

SEQ ID NO: 169409 - DNA, 1956 bp, Homo sapiens
  Payload ID: 13349
  Gene Symbol: PRR19
  Gene Name: proline rich 19
  Uniprot ID: A6NJB7
  ENST ID: ENST00000499536
  CDS Start-End: 812-1882
cctagcctcaagcgatactcccgcctcagcctcccaaagtgctaggattacagatttgagccaccatgcctggcctcatctggtcattctaaatagtattcccaccacaccccaaaacatctccctattcacttgttttgttttgttttgtttttgagatggagtctcactctattgcccagactgaagtgcagtggcacaatcgtgactcactgcaacttctgccttctgggttcaagcaattctcctgcctcagcctcctgagtagctgggattacaggcgtgcaccaccatgcccagctaattttttttttttttgagatggagtcttgctctgttgcccaggctggagtgcaatggcatgatctcagctcaccgcaacctccacctcctgggttcaagtgattctcctgcctcagcctcttgagtagctggaattacaggtgcatgccaccacgtctggctaatttttgtatttttagtagagatggggtttcactatgttggccaggctggtctcgaactcctgacctcaggtaatctgcctgccttggcctcccaaagtactaggattataggtatgggccactgcggctggccaatttttgtattttcagtaaagacagcattttgccatgttggctaggctggtctaaagtgacctggcctaagtgatcggcctgccttggcctaccccagtgttggtattacaggcataagccaccgcgcccagccctccctattcactttgctactccccttgacttatctgcatgctgatggccaccctatctttatattccaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctgaggctagggctggggacagatatcttgtactcccagtgacctcaataaagtacttttcatggtc

SEQ ID NO: 169410 - DNA, 746 bp, Homo sapiens
  Payload ID: 13349
  Gene Symbol: PRR19
  Gene Name: proline rich 19
  ENST ID: ENST00000595750
  CDS Start-End: 128-746
gagcccgaggcccggaacagcgccaggtgacttcgagagctggggtcaccgcggaaaagaagccattgcgccccacagctacgtgaagtgggaagggccggggttcgttggggcgagagaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggggccaagcctggggtct

SEQ ID NO: 169411 - DNA, 1641 bp, Homo sapiens
  Payload ID: 13349
  Gene Symbol: PRR19
  Gene Name: proline rich 19
  Uniprot ID: A6NJB7
  ENST ID: ENST00000598490
  CDS Start-End: 413-1120
tgctcccttaggcagcgcctcctcaactgccctcagtttcccaatcaggtagtgagagtggcacgaaccagccgttctcctgagccaccccccgcgcccccggactcctcaatatcccaggtgggaacgctcaccagggacatccagcgcccgtcgccctgtacgtcctgcaccggcgtgggcttgctggctgggttctcctctccactcatcttggcgccgcagctcctgcaggatgagcgagtcgggtcggcccgggagtgttccgaacggagctggctccgccacgcccactcctacccctcgcggcaacaaaggaccgtcccaacgctagcacacccgcggaggacgaaggccgatacagggcgccgcctcctctccagggacggaagccttcacttaggaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggtgagcgtccctcctgcccctgtactcccctttcctttgtcggctctagctcagctagcctctatgcttctttcctctgtgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctgaggctagggctggggacagatatcttgtactcccagtgacctcaataaagtacttttcatggt

SEQ ID NO: 169412 - DNA, 1847 bp, Homo sapiens
  Payload ID: 13350
  Gene Symbol: PRR20A
  Gene Name: proline rich 20A
  Uniprot ID: P86496
  ENST ID: ENST00000377931
  CDS Start-End: 234-899
atataagagggacggcgctcggcctccagcagtcggctttctgctgggctcggagccagaacctgctgcgtgctccctccagactccctggctgcgggtggactacctcagagctacagcggtgaacctgtggacacctccgactcctcgggcctctcttcgtcgaagagtctcctaattttcagatctccggagccagctgtgggaagatcagcccctcccgccgattgctcatggaggaaccaaggccttcgaagcgacttcgctccatggcccctaatcaagcctcaggtgggcctcctccagagccaggctgctgtgttgcggaccctgaaggctccgtggaagcagatgggcccgcacagccagcccaacccgcaaaacccatcgcttacgtgaaacccttcagacggcagcccccagctcgcccagagtcaccccctcctgcagagagaggccggcgccggggaggaagccggcggccagggcgaggccgtggcagaagggctgggccccgcggggacgctggccagagacagggggcagaaggcttgatggcaccggacgtgcacatccaactggaccaccatggagagccaggccaccagggggaaccggaaatcacggagaccgcagccttctccctttctgaaacaggtcctccgcctggaactgtgcaggaaggccctggccccgacgtggcgcaacctgagctggggtttcaggagccgcccgctgctcctgggcctcaggctgttgactggcaacccgtcttgaccctctatccctgcatcgggtttagggctctgggtgactcagcggttttacaagtcattcaaaccccccagggcacctacgtgcaaggggtcccagtgttcctcaccgacattgcgtattgaccactatctgccacccacgttgttcccagcctcccttccttccacctggacgttccccccagccccacttctgctccactcctcccccgactggacctgaagcctgagcttcccctgaacttggagtacgcaacttacaacatgcaagctgccaaacaccctttctgtacaaggcgattggaatggaactgtcatgtacagtgaaagtacacgtcacgtttttcagccaagaagaagccaacccagacaacctggaagaagtgggatgcaacaaggatcactaagcatggaaattaggaaactgtattcttaagtccagagaagtacgattctggaaaaaggattgatgacctagaattaaaattccagaagacactcatatagacatgtgggacatgcgaaaactcagaaggagctagaagttactaaagtgcttctctagtgcctggagacgatagactggctgaatataagagcaataaaaatctagactgacacatttttaagtctcaacgtgggtaccctttgggaaccactaaatgaattggaatagaaggtaaaatttcaaacagattgaggaaaaaggggatcaaaggacatgtgacgaatcagacaaaaggtgttggggtgggggggggggcggttaacggaagcaaggagagtgcatgactcactggaaccgctaaaccaggaatcagtaatttgacggcagtgtccttggcttcctcctggctttaatgggaatattttgaatgtttcaccattaaccaagatgttggctgtaggtgtctcttagatgtttaagttgagttagttcccatcttttcagagtttgataaatgttgtattatgaacttttgtattttgtattttattaggtaggctgttgttggctggttttcactcctttgtaaacgtccaaataaaatacagataactttttacatc

SEQ ID NO: 169413 - DNA, 1847 bp, Homo sapiens; identical to SEQ ID NO: 169412
  Payload ID: 13351
  Gene Symbol: PRR20B
  Gene Name: proline rich 20B
  Uniprot ID: P86481
  ENST ID: ENST00000377930
  CDS Start-End: 234-899

SEQ ID NO: 169414 - DNA, 1847 bp, Homo sapiens; identical to SEQ ID NO: 169412
  Payload ID: 13352
  Gene Symbol: PRR20C
  Gene Name: proline rich 20C
  Uniprot ID: P86479
  ENST ID: ENST00000544357
  CDS Start-End: 234-899

SEQ ID NO: 169415 - DNA, 1847 bp, Homo sapiens; identical to SEQ ID NO: 169412
  Payload ID: 13352
  Gene Symbol: PRR20C
  Gene Name: proline rich 20C
  Uniprot ID: P86479
  ENST ID: ENST00000614894
  CDS Start-End: 234-899

SEQ ID NO: 169416 - DNA, 1847 bp, Homo sapiens; identical to SEQ ID NO: 169412
  Payload ID: 13353
  Gene Symbol: PRR20D
  Gene Name: proline rich 20D
  Uniprot ID: P86480
  ENST ID: ENST00000452123
  CDS Start-End: 234-899

SEQ ID NO: 169417 - DNA, 1847 bp, Homo sapiens; identical to SEQ ID NO: 169412
  Payload ID: 13354
  Gene Symbol: PRR20E
  Gene Name: proline rich 20E
  Uniprot ID: P86478
  ENST ID: ENST00000434815
  CDS Start-End: 234-899

SEQ ID NO: 169418 - DNA, 1170 bp, Homo sapiens
  Payload ID: 13355
  Gene Symbol: PRR21
  Gene Name: proline rich 21
  Uniprot ID: Q8WXC7
  ENST ID: ENST00000408934
  CDS Start-End: 1-1170
atgcatgcctgttcatccacagctcttcatccacggcccttcatccacggcttttcattcacaacttttcttcaacagctcttcccccacggctcatccacggctcttcacccatggcccttcatccacggctcttcacccatggcccttcatccacggctcttcacccacggcccttcatccacggctcttcacccatgtcccttcacccacggctcttcacccatgtcccttcatccacggctcttcacccacagtccttcatccatgcctcttcacccacggcccttcgtccatgcctcttcacccacggcccttcgtccatgcctcttcacccacggcccttcgtccatgcctcttcacccacggcccttcgtccatgcctcttcacccacggcccttcctccatgcctcttcacccacggcccttcctccatgcctcttcacccacggcccttcctccatgcctcttcacccacggcccttcctccatgcctcttcacccacggcccttcctccatgcctcttcacccacggcccttcgtccatgcctcttcacccacggcccttcgtccatgcctcttcacccacggcccttcgtccatgcctcttcacccacggcccttcgtccatgcctcttcacccacggcccttcctccatgcctcttcacccacggcccttcctccatgcctcttcacccacggcccttcgtccatgcctcttcacccacggcccttcgtccatgcctcttcacccacggcccttcgtccatgcctcttcacccacggcccttcctccatgcctcttcacccacggcccttcgtccatgcctcttcacccacggcccttcctccatgcctcttcacccacggcccttcgtccatgcctcttcacccacggcccttcgtccatgcctcttcacccacggcccttcgtccatgcctcttcacccacggcccttcgtccatgcctcttcatccacgtctcttcacccacggcccttcatccatgcctcttcatccaagtctcttcatctacgcctcttcagccacagctcttgcctggtgggcttctcacagcagggcaatgtcttgctgctgtctgccagggccaccttcaacacctgtcttcttgtttctaacatgtactttctaataatctcttactaa

SEQ ID NO: 169419 - DNA, 1392 bp, Homo sapiens
  Payload ID: 13356
  Gene Symbol: PRR22
  Gene Name: proline rich 22
  Uniprot ID: Q8IZ63
  ENST ID: ENST00000419421
  CDS Start-End: 106-1374
aggcaaacagaaccccaccaggttctcagcctgttctccggttgggccacttgcactcccactgccgccctcctggcctgtctggaccgggccccccgctgccccatgcagcaccccaaaccgttctgtgcccctgcagctccccaggaaggtttcagcccgcagagtctggagggggctgaggtgctgggcaaccagcctgctcccacctgtgccgagcctcctcccgctatgggctccttgaacctgtatcatcccccagacccagagaaagaggtgtttccagccccaccagcaggtttccagatggccccatgcgggtgcttcttcgacccccgcatctatcggatcgagtggaccacccccgacctgggccagtcagccctgtataagctggcagcaagcagcggggggccagcgggggtcccctccgccccaggcagctacctcctggagcctcagccctacctcaaggccccggggctgcctccatacccccactaccagcaggcacccggggggccccagtttctcttgccctacttcccgcctgagggccccgggccagaggctctgggttttgtgggggacgcagggcccgccgccttcgtggagctgcccctaccgcccctagaggaaggcccggccccgctgccacccccaccccccaaggagaacaagccgccccctgtactcatcacgctgcctgcagagcccacactgcccccagacgcctacagccacctccagggtcacctcggccacttccctgggcccgaacccctggccttccccgtcaaggagctgcagggcagtggggcccgacctggggtgcccctgtacccaccgggcctcagcgagctcaaggtggccgaggtcaaggagggggccctgctgggagcaggcaaggccaaggcccccaagacggccagagctttggcactgcctgacaaggttctgctggaggacgccatgaagctcttcgactgcctgccaggcgcctctgagcctgagggtaccctgtgcgaggtccctgggccggccctgcctgacagcagtggtgggaactcagccgatgacatccgctcgctgtgcctgcccgaggagctgctgtcctttgactacagcgtgcctgagatcctggacaccgtgtccaacgttgactacttcttcaacttcaaggcgctcgacgaggagcagccgccccacccggggccccctgccaccaacaccccggcccccattctgtctggcaagagaaaggcctcgacggccaagaagggaaagccgggaaggaaggccaggcagccggcaggcccagccagcgccactcccccggggcccagggaggacctgggagccaccccgcattaaagcacatttgacctttca

SEQ ID NO: 169420 - DNA, 1640 bp, Homo sapiens
  Payload ID: 13356
  Gene Symbol: PRR22
  Gene Name: proline rich 22
  ENST ID: ENST00000390672
  CDS Start-End: 1-248
gtctggagggggctgaggtgctgggcaaccagcctgctcccacctgtgccgagcctcctcccgctatgggtacgatcgggtgggtgggagcacctgctggagagggttcaggggcccacccgcctaagggccctacccacctgggcacctttgtccacaggctccttgaacctgtatcatcccccagacccagagaaagaggtgtttccagccccaccagcaggtaccggcctcccctgagcccttgacgaggctgggagtgggtttgagtgtgcaggcccatcttgcccctgccccgtccctaagtgggagcctgaaggcatggcctctgctccccatgcttcacacaggtcccccagatgagccccaaagacaagctctgtgtcatccatcacccagccagggccccaaagcaatatctatgtcgtcccccaaaggggccccccaatggcaaggttcttgtggcatctcccaaacaggcccccaggcttgggctgggcccctcaggcagcagctgctctcagggcacccgcctgccgcccacaggtttccagatggccccatgcgggtgcttcttcgacccccgcatctatcggatcgagtggaccacccccgacctgggccagtcagccctgtataagctggcagcaagcagcggggggccagcgggggtcccctccgccccaggcagctacctcctggagcctcagccctacctcaaggccccggggctgcctccatacccccactaccagcaggcacccggggggccccagtttctcttgccctacttcccgcctgagggccccgggccagaggctctgggttttgtgggggacgcagggcccgccgccttcgtggagctgcccctaccgcccctagaggaaggcccggccccgctgccacccccaccccccaaggagaacaagccgccccctgtactcatcacgctgcctgcagagcccacactgcccccagacgcctacagccacctccagggtcacctcggccacttccctgggcccgaacccctggccttccccgtcaaggagctgcagggcagtggggcccgacctggggtgcccctgtacccaccgggcctcagcgagctcaaggtggccgaggtcaaggagggggccctgctgggagcaggcaaggccaaggcccccaagacggccagagctttggcactgcctgacaaggttctgctggaggacgccatgaagctcttcgactgcctgccaggcgcctctgagcctgagggtaccctgtgcgaggtccctgggccggccctgcctgacagcagtggtgggaactcagccgatgacatccgctcgctgtgcctgcccgaggagctgctgtcctttgactacagcgtgcctgagatcctggacaccgtgtccaacgttgactacttcttcaacttcaaggcgctcgacgaggagcagccgccccacccggggccccctgccaccaacaccccggcccccattctgtctggcaagagaaaggcctcgacggccaagaagggaaagccgggaaggaaggccaggcagccggcaggcccagccagcgccactcccccggggcccagggaggacctgggagccaccccgcattaaagcacatttgacctttca

SEQ ID NO: 169421 - DNA, 1587 bp, Homo sapiens
  Payload ID: 13357
  Gene Symbol: PRR23D1
  Gene Name: proline rich 23 domain containing 1
  Uniprot ID: E9PI22
  ENST ID: ENST00000533250
  CDS Start-End: 178-1017
catttgaccggtcccaggccaggacacactcttccatgctctggctgtgctgtgctagaggctgataatttttctccaggtagagtaaaagatcaaggcacgaactatatagatttacagaaaataggccaaagattgagatttttttgacacaagcaagtccagagaacttttaccatgtatggttaccggcgcttaagaagccccagagattcccagacagaaccgcagaatgacaatgaaggagagaccagtttggctaccacacaaatgaatccacccaaacgtcgccaagtggagcagggtcccagtacaggtgcaaaaaaaccctcaatttcaggagctccacacctgaattcataccagtccctggaacttccccagaatcagcaggattctggcactgaggagctcatgatagtcctggaacaagggacagaagtgaggttgagcctggaagaggtcatcctcatcttggccccagagacagtgctgcagctgaccctggagaacacagtccttgtgattgtccctgagcatgtcctgaggtcagaagatggcctgcagtcccctgtgcagatccagtacatcataccttccgttgatgacttcagcttggagttccatgctcaagatggagacatctcagacatgagaagagagaatgtgcctttttcacctgcagaagaagggaaggcagcacccctgtatcagcagcccttgatgataccccaagcaaaccacatggctgggatcagcccttctttcctagtaaccccattgtgcattccacgctgtcgggcagccttcccccaatgctaccctctaccacccacacctagtcctgtgggacgccctagaccagccgactccagtttcagcctgcatggtatggagctcttgtgcacctcctccctcagacctatgcccccttcaccaagtcctggtccccaggtctatcacagggttcaccataggcctcccagcagggcacggagatgtctctttaggaagtgatttaacccaagagccaccccctgcattgataggtcagagattgtccagatccttagtcagtgcattctctgaaatgtggagagaaagtaatttgaccacttgcttgccctttgctgttccccatcatcaaccactgtcttcaacagcggagggtcccagatgctgcagggagggggagaactgcagggagttcaaataaaacattcacatttcacttcacacacactgtcccttagactttctcttcctatttaagcacatacatccaaccacactcaatcaaatccctgactgctccatgtgagagttctgcttccagcatgacgtggtctgaaagttcatctgaagacagctgctcactcccgggggctaacaccgccccttgcatgctgatgtccttgtagtcattggtctgatgccacaataaataattcctaaggctgatgctctatttctgccctgagactctcccctttttctccaagctgtgccccattccttgtcttagtccaggttccctacactccccaggccaatgcttttgaataaatcttgacgtcattgaatgaa

SEQ ID NO: 169422 - DNA, 1587 bp, Homo sapiens; identical to SEQ ID NO: 169421
  Payload ID: 13357
  Gene Symbol: PRR23D1
  Gene Name: proline rich 23 domain containing 1
  Uniprot ID: E9PI22
  ENST ID: ENST00000610320
  CDS Start-End: 178-1017

SEQ ID NO: 169423 - DNA, 1587 bp, Homo sapiens; identical to SEQ ID NO: 169421
  Payload ID: 13358
  Gene Symbol: PRR23D2
  Gene Name: proline rich 23 domain containing 2
  Uniprot ID: P0DMB1
  ENST ID: ENST00000528972
  CDS Start-End: 178-1017

SEQ ID NO: 169424 - DNA, 801 bp, Homo sapiens
  Payload ID: 13359
  Gene Symbol: PRR23A
  Gene Name: proline rich 23A
  Uniprot ID: A6NEV1
  ENST ID: ENST00000383163
  CDS Start-End: 1-801
atgggcagccggccccgcagccccagcgccttccctgcgccctggtggggacagcagccaggaggacccggccctgccaagcgcctccgattggaggagcccgcgggccccgaaccccgcgtggcgcccagcctggaagacccggcgggtaccccggccgtgggcgcgctcacctccatagtggtcctggccgcgggctgtgccctgcgtgtgcccctggacgacgtcgacctggtgctggagctcccgccaacgtcgatcctgcgagtgtctctcgatggacacaccctcatcctgatcccagaggtcctcctgagctctgtcgacgaacgctcaggagcgcaggacgactcgtctgctgggctggaagtggacgttttcctgggcgctctcagggaggacgtcgtcgttgagcaggaagtcttctgcgcatctgtcccagagatcgccgcccaggaagaggcctacgaggaggacgcggaccccgagtttccggagctccagatggactccgcagccggctcagccgctgggctctactcctccgccagaagtatgttcagcccctaccgggagggccccatcccagaaccctgtgctctggcccccaaccccagttcagagggacactctccaggccccttcttcgacccggaattccgccttctggagcctgtccccagctcacctctccaacctctacctccctctccgcgcgtggggagtccaggtccccacgcgcacccgccgctcccgaaacgccctccgtgcaaggcccgcagacgactgttccaggaatga

SEQ ID NO: 169425 - DNA, 1896 bp, Homo sapiens
  Payload ID: 13360
  Gene Symbol: PRR23B
  Gene Name: proline rich 23B
  Uniprot ID: Q6ZRT6
  ENST ID: ENST00000329447
  CDS Start-End: 266-1063
gtctgcatcaggaaggcccaagggtccaacgagctaagctgagcccggtggccggcgaggcaccaccagcagcccagactacggtcccccaggaggcgccccgggagctccgaggactcgccccgcgtcgcgcggtcctgcgccccgctcgtcccaaccagcctcccctaccaccgacatctgttacttcaaagaggacttcaccgccgcgctccccacgtccgctgctaggcccaggagcgccgtccacagcgccgtcgaggcgatggtcagccggccccgcagccccagcgccttccctgctccctggtggggacagcagccaggaggacccggccctgccaagcgcctccgattggaggagcccgcgggccccgaaccccgcgcggcacccagcctggaagacccggcgggggacccggccgtggacgcgctcacctccatagtggtcctggccgcgggctgtgccctgcgtgtgcccctggacgacgtcgacctggtgctggagcccgcaccaacgtcgatcctgcgagtgtctctcggtggacacaccctcatcctgatcccagaggtcctcctgagctccgtcgacgaacgctcaggagcgcagcacgactcgtctgccgggctggaagtggacgttttcctgggcgctgtcagggaggacgtcgtcgtcgagctggaattctgcgcatctgtcccagagatcgccgcccaggaagaggcctacgaggaggacgcggaccccgagttcccggagctccggatggactccccaaccggctcagccgctgggctctacccctcctctagaagtatgttcatcccctaccgggagggccccatcccagaaccctgtgctctggcccccaaccccagttcagagagacgttctccacgccccatctttgacctggaattccgccttctggagcctgtccccagctcacctctccaacctctacctccctctccgtgcgtggggagtccaggtccccacgcgcgctcgccgctcccggaacgccctccgtgcaaggcccggagacgcctgttccaggcatagacccccacccccacgtacacacaacaatcctggccgctctgctggaggccctctaggattgcgggaatctctcacattgagtatccaacaacctggaaattgggcaccgcgtgttcggacaattgctttttcgctgcacactaccgatagtaggagatgaagacgtcagcaagaaaaggtatattctagacctcatctttaaatagaaaatctgcgcaaggataccagaaaatgtgtccagatttctgggcttctttacaaggtcatattcagatcccttcattctccctcgttttgcatcagttgtttctctcaaattccagtctttctccagcatcatactgccactcccgtttctccccaaaccaagaaatcaccagatctcttacgttgttagttaccttgcatttttttcccatgaattttggaagacttagccatggcttttcttggggtttttccaactgctctccaaggaaactgccaaatagtatgcttactatacaagactgtatgttgcttcttcctaggaaccccttatcctgctgaagttttcttctagtcttctaattctaaatgaaaatttgtgttgaattttatcagatgttttcagcatgcattgtgttatgtatttttttttaatttgttaatctggtgatttcacccaatggaaagtgtttgcattcctgctattccacattattttataccttttaaaatctaccctgagttttttctcatgtaaaccaaacttctaacttttaaaatgttagtttattactgtagttgcctcatatttttatataggagataaaagattactggtaaagctg

SEQ ID NO: 169426 - DNA, 2791 bp, Homo sapiens
  Payload ID: 13361
  Gene Symbol: PRR23C
  Gene Name: proline rich 23C
  Uniprot ID: Q6ZRP0
  ENST ID: ENST00000413199
  CDS Start-End: 273-1061
aacataattggctttgcagtgcgcatccgggtctgcgtcaggaaggcccaagtttccatcgcgcgaggctgagccacacagcgtgcgaggttcccccagcagcagcaccgactccgatctccgggaggcgcccccagagctccgaggactcgccccgcgtcgcgcggtcctgccgacacctgttacctcaaagaggacttcgccgccccgagccccccgcacccacgtcccctgccaggcccaggagcgccgtccgcagcgccgtcgaggtgatgggcagccggccctgcagccccagcgcctgccttgcgccctggtggggacagcagccaggaggaccaggccctgccaagcgcagccgattggaggagcccgcgggccccgaatcccgagcggcgcccagcccggaagacccggcggggaccccggccgtggacgcgctcacctccatggtggtcctggacgcgggctgtgccctgcgtgtgcccctggaggacgtcgacctggtgctggagctcgcgccaatgtcggtcctgcgagtgtctcttggtggacacaccctcatcgtgatccccgaggtcctcctgagctccgtcgacgaatgctcaggagcgcagggcgactggtctgccggcctggaagtggacgttttcctgggcgctcacggggaagacgtcgtcgtcgagcaggaagtctgcgcatctgtcccagagatcgctgccgaggaagaggcctacgaggaggacgcggactctgagttcccggagctctggatggactccgcagccggctcagccgctgggctctacccctccgctagaagtatgttcagcccctaccgggagggccccatccgagggccctgtgctctggcccccaaccccagttcagagagacgctctccacgccccatcttcgacctggaattccatcttctggagcctgtccccagctcacctctccaacctctacctccctctccgagtccaggtccccacgcgcgcccggagctcccagagcgccctccgtgcaaggtccgaagacgcctgttccaggaatgagttgcctcccacaatcccttgccaccctgctgggctccaggagaccgtctcctgatagccgttgtgtgtatgttgcgcaacctacaaggatctcggagagtggataacggatagatgcttttttgatacaggctgcgttgcagaattctggatcagtggctgacttagaaagtctggaaaaaaaagatcctcctcctcagcataaaaatacgctagttgaaatacagtctactttcagactgtgagattgctgcttcgggcctgttttgtttggaagtcacccctaggcagctccattccccctggttttgctttgaacctcagttccagcacatttctctaaaaatccgccctttccccagcacgttaccatggcacaccttttctcccaagttaatttactacatttattttgtttaatgggttttggccctagtctctgggctagtttatgacgaccttctcaacatggaatttttccctatggtggcctgagcccttttgggtgatcttgcacatagttgtacctggacaaatgtttgttgtttgcaaaacagaccgaactgggaataatgatcatgtaccctcctttttttcatgattggtttagcaaattgtttatgttattgggctttatttcccccctaactcttagagccagctcttttccattcatttcttcttctatgtttttaatataattattttatcctggaaaagcttataattctaagactctgtgtgtgtatgtgtgtgtgtgttgtttgtttgtttgttttttgagacaagagtttcactcttgttgcctaggctggagtgcaatggcacaatctcagctcactgcaacctttgcctcccaggttcaagcaattctcccgcctcagcctcccaggtagctgggatcacaggcatgcgccaccacacacgactaattttgtatttttagtagagacggggtttcaccatgttggccaggctggtctcgaactcctgacttcaggtgatccatccacctcagcctcccaaagtgctgggattacaggcacgagccatcgcacccagccggaaataatttgtttcttaggttgatgtatcaaatgcaattactgaatttctttaatggtgtatgtgtagattctcaattgattgattgattgattgataaaaacaatatctccaaataatgagaatattgtcttttttgacaagcttcatacatcttatttttctttaatcttttatattggacattacttcaagtccagattgaacagtatggttaatatgggcattcctgttttatgccttgtgttaatgcttctaaattttaccataaagtatgatctttacatggttgttagataacccttaatctattgaagcagttaattttcagtctttcagatcatgaaaaactgttgaatttttgctttgtttttgcctgttactacaaagatgttatcaagttgttttaaatgttgacatttaattatttgtgtgtatacaataatacaatacaatagctagatggaacctttgggccacaagagtacgtacagaaacctggcaagagcgctaatgagaccaggctttgggcttcagggatttaaaacaattggatgctttatgaggacttgagaagacacaagtggaaggagaaaggcagtaactgtagggtgcatttaaggttttaaatgttaaaaattaaagaaacttttttttctgtatgc

SEQ ID NO: 169427 - DNA, 1209 bp, Homo sapiens
  Payload ID: 13362
  Gene Symbol: PRR25
  Gene Name: proline rich 25
  Uniprot ID: Q96S07
  ENST ID: ENST00000301698
  CDS Start-End: 1-1209
atggcccgaactgaccagaagcccccgtgcagaggtggctgctggggacagccaggtcaccccaacacgggtggggcagctgcacaccccacttaccaccccatgggtcacaggcctcgaacgtgcatcctgctacgtggagaccagaccacaggtggccaagctccgtctcgggaaataagcctggggccctgggcggccggcactcacttcctggctatctctaccaccccatggggcaggaagacacccgcctgcatttctgagctcccaaccagctcaggaacagcgcagccgctcgcaaatgcagtgtgcgaggtacagaccgttccagggcctggcctgcgcccacagggaactcctgccatgcgggccccttctcacaaggggacaccgcccacccccaacccctggggcccagagcagccccagaacagacacaagcatcccaaaaagggggtcactgggggcccctcgccgccgcctcctgccgcctcccgatatggccaaacacccgggcgcgagccccgcgtgcaggcgccgggcctgggcccctgtggccgtcccgccagcggccgtcttctgtccctgcatttagagaagggggatggcaaagggacccgccagcggatccctcttacagatgctgccgtgggcggcgaccgcacagacatcccctctgctattgctgcgggaccggcaaggacgccggaccgacacggcctccccatccctgggtccaccccgactcccatggtggggagcggccggcttggagcccctgtgggacggagtggaggtggagcaagtgcccggagctctcggccatcatgtgcgaatgttttgctccgtgctgacgcctccctcggcaccgtcctgtctgtgttgtggactgggcagctctcacggggttgggcgcttctgcccccgggggacgctggccggcatctggagacgtctgtgatctccgctggtgttgccgcaggcatctggctggtggagcccggggaggccgcccaggaccctgcgacccgcaggaccgccccgccgcggaggacggccagccccgaacccccagcgcccggggcacccctgcctgcctgccctgggcggatccccggggccgcgcggttcgggccgcgctcctgcccgctggggtctcccgccgtcctcgccgtcaccaccgggtggagccacaggtccgtgtga

SEQ ID NO: 169428 - DNA, 7250 bp, Homo sapiens
  Payload ID: 13363
  Gene Symbol: PRR26
  Gene Name: proline rich 26
  ENST ID: ENST00000381489
  CDS Start-End: 35-631
aggagagaaaatagcttgacacctcctgcggcccatggagtcctcccgttgggacaaggaccccccaggagagagaagaccccagcagagtcaacactggaggtcctgcggggtgggtggtgctggggaggccacacggggagggctgttccctgttcccttcccctcaggagacagctggcccgaggtgacacagcactggatgcgatttcagggccagggaccatggtgcccggggctgtggaccacgccagcccacagccactgcaagccccagaccggggctgtggataacgccagcccacggcagccacacgccccagaccaacacgagaagaacgcaggccgacaacatcttcatctatggagcctggcctgtcccccgtggctccacagcataccgcacatcaaaggcacgattctctccgaagccctcagtggcttcctagtatctgacagaagaaccaaaactgtggcaggcctgcgatggctgtggttgaggaaagaggccacacccacagccagcagaaccacactcagcagcagcctagccccacgtggaagaggcgtgaacactctcgggagaggtggatgtacgctaatggttctcagctccgacctctgtgattaacagaacatgctgattggttttatctgaacgtcacacaaaagggtttctatgtccaggaaagactctaaacactctggaccctgctggggcagatggtgaccgtgacccagtgataccactctccagtgggcagcctggtctgcagagggggagatccctggggcagccctacctcagcatgggtgagtttctgttgcaattctatgtccagtgtaaataaactgtggaaaactgggagatggtacaagaaagcaaggatgccaactaaatgaatagaaagatctacaagggaaggctgagatcagctgaaataggattgggaaagtaaaggcctggctggaacttcgtaatggcttttgaggctcgggaacagggacagtagctgccctgtccatcccaggagagaacagacggacatggctggaaagcacttccctgactaaaagtgtctttaaaaagggagatctcagaatctccttccctggaatgctttaacccttcatggaacacagcagaaattccacagccctgcatcccaggaagcagggacaggacagcagcttccagcacacagaagcatttagaggcataagtagctacgcaaagacagcaggagccgtgcctcgaaaaggctgagatgtctgagaaataaagttgtacgcggatttacgcctgggcaggttgaaatgcgtgtgccatgacagatccggaagcttgtctactcgaaggtccacatccaggtatgtttcacagtcatcacaactagattttcagaaatttaaaactcctaatgaagaaacacaaacctgcacgtctcacgccaccacttaaggcagcggctctcaagcaggggcgattctactgggaggagggatgctgatggcaccagagggtgggaagcagggatctgacgcttagcaccgcaggtgccaaggacggcctcctccccacaagggctccgggaggccacaccagagggtgggaggcaggggtgacgctcagcactgcaggcaccgaggacagcctcctcccaggaggaaaaaacaaagacgggaaaaaacaaaggctccccacaagggctccagggggccacaccagagggtgggaggcaggggtgacactcagcaccgcaggcaccgaggacggcctcccacaaaggctcctctgggccagagcatccgtagtgccaaggggaaaagcccggacacaaaggatccagtgttttcaacgttgctcagggtatctccacacagaaactcccatctgccttttgtgcaaactctggggtcttgcaatcgataaacgttcacaagacacaacacgtgaacctaacaattctcttttgctccaggagagagaaaagaaggaatggtttggggagattcaccgaaattctgtgagttcttgactaaaaatcaccaagtccgctgtgttctgttatcagcagtcctgggtaggcccagacccacctcacccccagcgggacccaggaaaggctttaaacctcaaacgtcccttttcgtaacactggctgtttcatgtggttaataaatcatccaataaaatgacacacataagcccagttatacactcgacacattaacactattgatcattgttatatgtccgggttaatcaacattacaatgctacagagaaatcattggtactaagagttgtaaggatgattttttaaaatttatgtatctcaattttttatactgttactttttacattttaaaaaatgtatattctgaaatatttttgatattttaaaatgttaatgtatcaagcattttaaaatgaaccaaatatatatctacaaatatatagggaatttttaaataaatatcagggtagaaggaattaaaactcctaacttaatactaaatagacgggaaaaaacaaagtagagagttctcacagactcctgaaggaatatatagtaataaagctcaaaaagtacattaaaacctttataacgatgttttaattaccaactaacaagaaaatatctactgaatcgcgactagcagatacccaggtctgttcagcacctgtactctcccctaggtctgctgaggaacagatcaattctgttggagttgaccttgaaatttaaaaaaacaaaacaaaacaaaacaaaaacagctttaaagatttaaatttcctgaataaaacagaaaataaaaataacacttctgcacctgtgagttctcttgaccctaatttattttttgctttggatggttcataaaatatacatatataccttaaccgtgctttatattatatactagtgattgttaattcattattaacctcactctacagctaaattctaacactaatcatggtggcatcattaggacattgttctaggtggtgcttttttaactgaaaagaaaaacgggggataggtaataaataattatgtaatctaaagaaaaagttttaattgtgtgagtccagtaacgcgatcatctagcatggaaaatattttcagtagttccaggaaacttcacataagaaacactaaataaattctaagttcagtatatgagttagagacatttccaaaaggaaagcacacacagttggttgggagcgcctggattttctctagcaaaagactcgtggaatccatgctttcgccgccacgtgacgaggcacacgcggactgggacatcgtcctccaccctccagaaccaaacgctacgcgaaaccacagcgccagattcccacactggaaaatccctgagcaaagactcacgtgactcctcctcagccgctttcccaaaacaaaacacatcaatcaaacgaacccgatgaaatatacgagatcgaaaggaaaacaagagccaggcttatctcttacaggaacactccataaatcttacactgaattcactcatccttccacacaatctgctgataagaggtaaataatcaagtggaaatcactcaaagaagcgctttcctcccccaacagacgccgaagtctttgccgtggcacttatggggtgctctaacttctcagcgctggccgtcaccaacgcaggccggcagcaccctggaaaggcccaggtcccgcagctctccctccacgcgtggctacggtggaggaacgaagagcagctgtgagttcgtgggaaagaagggctatctggaataatacgagtccgggtgacatatgtaattgtgagtttttgttttctccgaactggccttattattattaattattccttcagcacctaccgggaaagcgagaagaaagcaaagggcatcactccctacccacgaaagactcacaacatccctggaaaagcaacgaggcgaacggctggtctgcgttcagagctggtgaggagcagggagaagaatccagagcgtccccgcctccctccctcaccgccctcccgcactgatgtgaacacgggagtaacaccgcgcgtggggaatccactggcacccagagcccggcccgcggcagcagaatcacccaagactgagatcctgtggcctgagtcggggccggggaaaccaagcctgcaggactccgggagcagccggtttctgcacacaggtaacatagaactgggggtaagcaaagccacgaggtcggcccgtggcctgtctgcccgtggcctgtctgcccgtggcctgtctgcccgtggcctgtctgcgcacagctattaaaagttcaataaacgtggtggcagcagctgaactggctaccacaggacgcagctggggtctggacgtgggcctgggggctggtggaaggcacgtgtgttgaggcgtgtactcagggcctgcctacttccccaggcctacggggacagatgtagctccccaggaaataccacaggcagaccccggccggcaagctgccccaagaagcagtgcgcctcccaaaatcagaagcagctaagctgacccccacctcatgtgaaagagccaggcaccagggagagggcacccacccagtctcctaatcataacagacattcacagcaacaccacgaaaaagaaactactgctctgacctggaaaaatgaaatttaaaacagaaaacacacaggttgtaactaaaaggcagacggaccaggtgcggtggttcatgcctgtaatcccaacaccttggaaggccgaggcaggcggatgacatgaggtcaggagttcaagaccagcctggccagcatggtgaaaccccatccctactaataatacaaaaactagccagacgtggtggcaggcacctgtaatcccagctactcaggactgggaggaggcgcaggatgacgacgagagagagacgagagaggcagatggcccacggcaggctgagcacaggacctggctgaggcctcctggggaggggcagaggcaaacatgctgctgcttctaggctactcgggaggacgcacgctcagaaggggctgcacggcaggacttgctgaggagcagtcacgtggatgcccccgcctctcacaacgcacacactgacaacatgcaactcacatacaacacaacatgcatgtacaatgtactcatacaacatatacaacactgacaacacacaacacacacaacacatgcaacctatacaacacatacccaatatatgctactcacaacacaatatgcatttataacacactcatacaacacatacccaatgcatgcaactcacaacacaacacgtacgtacaacacatacacacatacagcacacgtaacacatacaacacaacacacatgtacaatgcactcatacagcacacacaactcataacatgcacatacaacacacaacactcatacaaaacaacatacacaactcacaacatgcacatacaatgcactcatacaacacaacacatacaacatacatgcaactcacaacatacacatacaacacactcatacagcacatgtacaacacatgcaactcacattcaacacgacatacacgtaccacacacaacacacgcaactcacaacacaacatgcatgtacaacactcatacaacacaacactcatacaacatacagacaacacatgcaactcacaacacaacatacacatacaacacactcatacaacacacacaacacatgcaactcacgcacaacacaacatgcacaacacaacatacaacatatacaacacaacactcatacaacatatatgtgtattgcatacacataatacatgcaactcacaacacaacatacacatacaacacactcatacaacacatgcaactcacaacacaatatgcacgtacaacacactcatacaacatacaacatataacacatacaacatacaacacatgcaactcaacacaaatacatgtacaaggcactcacacaacacacaacactgatacaacatacaacacatggaactcacaaacacgtacagcacactcatacaacatacaacccatacaacatacaatacatgcaactcatacaacatacacatacaacactcatacaacacacattcatacaacacaacactcatacaacatacaaaacatacaactcacaaatacatgtacaacacactcatacaacacataacactcaaacatacaatgaatgcaactcaacacaacatgcacatacaacacacatacaacccatgccactcacatacaacacaacacgctcatacaacacattcatacaacacatactgtacagattctaagtatgaaatagaaaacagcacatgcacagtttctaaagtatgacaaaagcttttttcaagaaggtcatccaacatccaaactggtaacatgtcctcattttcagctgctgttcagattcaagcatgtttatcatctgctccatgaattacaataatatagcataaacccttttttcattttacacccactttggtgtggggtgctccaaaacaggggccaggagcctcagtcatccctcggaacaaaacacaactcacactcagaggccaggaagggaactcggggggcgacacacactctctcatctgcagagctctgcttcaattactttacatgtaaccgcggctggaacggggttggtgacggtacagacacggcaaactgaggagaaattggcaggtggagaaagatcagccagaatccaaggaaaaatgctgagcattttccacaaatagttcacacaacggacaatagttgggctactgaaagtttattgagaggggtcttgctccaaagaaaaagttctttcccaaggttatcaaagactcacagcagaccccggcccccaacacaccatctgcagagggcctgttagtcaaaaagaagacaagacagaagcaagggggtgcggggggaggagagcaagaggggaccgagaactcggaaccaagtgatgggcagacactgaatgcctgactccagggttatcgcctcagaaaacaagtccgtttaagcccgtggtaacagtgttagcgctttcactgaacctgcactcaacactggagaacctccctgcattatgaagatgagccgaaaaataacattaattcacaatgtagagtgatgattcagccacagaaaataaaactgatataatccactacaa

SEQ ID NO: 169429 - DNA, 2251 bp, Homo sapiens
  Payload ID: 13363
  Gene Symbol: PRR26
  Gene Name: proline rich 26
  Uniprot ID: Q8N8Z3
  ENST ID: ENST00000441152
  CDS Start-End: 164-829
aacacatcaaaacggaaaaggaaatgtaagcagtgtttgccgtccaaagttcacatcaacaattccttattaggaaggcaattctgagcctttcctcctgcatctgggagctgccagcaacccagttccaggagagaaaatagcttgacacctcctgcggcccatggagtcctcccgttgggacaaggaccccccaggagagagaagaccccagcagagtcaacactggagggccagggaccatggtgcccggggctgtggaccacgccagcccacagccactgcaagccccagaccggggctgtggataacgccagcccacggcagccacacgccccagaccaacacgagaagaacgcaggccgacaacatcttcatctatgaatcctggctgatccaccatggaacccagatgtcctcagttctgcctcagcccccacttgtgagaggtccgtggcataacacaaactccccctgggattcgtgggcctcacgggggaagctgagggtgtgtccatgcaggaccccgaggctacacagctctggctgtttctcttccaaagccggcactgccctctctccatctctcccggtgccagggctcaggccccagcccccgtttctgcagaagcccctttccatcctagcccctgccacccctcctgctcttgtctctcccacacctcccaaactctctcctggccagctctcgccacactcagtcaatgtccactgggggcctcaggggcacctccacctgcccaggtctgggaccaccgtcctccacgcatatctacagaccctgtcctcacctgcatcacaccaatgatggcgtcacagcgtgggttccggtcaccagtcggcctcccccaccaacgtggactccttacaagcagagccaccaacgtggacacgatcccatcaggaaccacctacttttgcatccccagcactgtgctcaggtcccagggaggccccagcaaactgtggaacaaccaaactcgtgactgaatgaacaagtatgttaagtcgttaagtaaaaatagcagaagacttagtagaatgtatgagtaacaattacaattatatgaaaatccgtatccacgtgaaggtattatgcaaaaaaagcttaactttgtttcagtgcctttccagttaaatgttgttaagcagtatttcccccaaaaggtgcatcttttataaaacaagaacgcaaggctctgaggccaactttgaacatttatttgagtgaattcacgtcccccaaattttccgtatcccaaaatctggacttttgctaaatggtgcccttagcacaggagtctctccaaggaagtggcctgagctgagagggggcctggcatcgcccacccaggtcatcagtcatcatcagcagcagctgcggcatgagagagatggtgtggggcgaaaccaatggggaaactacaaaagaaaccacctgctactgcaaacggcctcgctgtactcagggagtcggttccaggaccccatggacaccaaatccaggcacactcacgccccacaagtggacctgccgaacctgcgtgtacagagtcggccctccgacacacgtttcacatggcaggaacactgtattttctccctgagtttggttgaaaaaattcacatataagttgacccacaaagctcaagcttgtgtggtacaagagtcaactgtatgcaattgacactgattcctaccaacgatatccaaatcttagcatgagcagcacgataaacagaatgagcaaaattcaaaaactaaagcagcgtttttcctgcaagtgggcgcactgcgtatcccctgcgggaaagaccacgctggctgctgaccaaactccactggcatcttcctccatcctgagggcatcttcctcggcatcttcctccatcgacagcagcctgggctcacctcccagcccgaggctgagaactgagttccagtcccggggtggggtggcgggggggcgcactgtgcaccctcccagctctcctccaccccttccctcaggctggcccaagaatagcctggacaatcacctgctggggacaccgggctgcccctcctccgcccacagcctcaggccacctgtctcatccgtgaccgagaaacggagctgcagtgggaggcgggacatgctgggatctacccatggccaggccaagctgcgccaatcactcaagcttcactttgatcacttgctctaccaaataaaacagaacaaaataa

SEQ ID NO: 169430 - DNA, 3127 bp, Homo sapiens
  Payload ID: 13364
  Gene Symbol: PRR27
  Gene Name: proline rich 27
  Uniprot ID: Q6MZM9
  ENST ID: ENST00000344526
  CDS Start-End: 190-849
ctgttaaggtatacagacagtagttaaatagcagggccaactattctgttaagggtcttcctagacagactaaaaaagccatgtattctttcgtttctctctaaaagaagaaaaatataatttaaaaatacattgcgtattttctaaaacaataaatttatagtgttaatattcatagggtcaatcaaaatgaagcttctcctttgggcctgcattgtatgtgttgcttttgcaaggaagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtccctccttcaaggtttttttcagcagctgcagcacccgctgccccacctattgcagctgagcctgctgcagctgcacctcttacagccacacctgtagcagctgagcctgctgcaggggcccctgttgcagctgagcctgctgcagaggcacctgttggagctgagcctgctgcagaggcacctgttgcagctgagcctgctgcagaggcacctgttggagtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcttttccaaagactatttcattctgttgtattcagagtattcatctcactacattgatttgtttgtggtagtttttccttggacttaatttatattgaaaaaacattgataattaaataaataaaatagataatttagaccaatggtgataaggtctggatgaaaactacgctatggaggactgaaatggcaatcattcagcctagcctggagtctgattatacagctactataggatgatgttagtattggttttgagtgcaataggttttttcctaaacaaacatattttgtagtcaatgaactttttgtcacaaaacagtaaaacatctgtgtttaacctatggtaaacaacatgttaatgaactatgctatccatgacttaatggacagttcaaatgtgacatctacagtttttcatttctcttttatgccagcacacaatcaattcatcaccaattgtcatttgatttacttcaaaaaatatacccccaaatcctaatacttctaaccttctccactgcatctagccaactctagctattgtcatccctaacagaaatggaggaatagcctctttttttttttttttttttgagacgaagtctcacactgttgcacggctgtagtgcaatggtgccaactcagctcactgcaacttccacctcccgggttcaagtgattctcctgcctcagcctcctgagtagccgggattacaggtgtgtgccaccacgcctggctaattttttgtaatttagtacagacaggggttccctatgttggccaggatggtcttgatctcctgacctcatgatctgtccgcctcggcctcccaaagtgctgggaatacaggcgtgagccaccgtgccctgccagaatagcctattaaccagtctacctgcttccacttttcctccaccctgatcacatacacacatgcattatccactgagcagtcacaatcagatgttaaaccaaacattattcagataagatctctgaaaagcctctgatactttctcttttaaaatggaatatattctaaacacctctccaaggacacaagacttaccttgtctaactaatgacttttctaacttcattccctatcattctccatcttgccccatgctcctcatgcagcagcttttttttttttttcctttttcaaatatgttggttttgatcttatccaagaacctttgccctgatgtatgaatgactaactgcttttctacttcgggggtctcatatagaaatcctgcttcagaatactcttccctgagcactctatctaaataaatccctcttctgcaacccagtgctttttgttctattactgacttcttttccttgtagaagttactattactgctttttacctttttatttatttgtgtattgtctttgttgttgccctcatcttatctccacaaaaatatatgctccataaaaacaggcatttctgtgtcttattcagcactttatcagggcctataacaatgcctgggacatattcagtgaccagtgaatatttttggaaggaaagaaaagaagaaagaatgaagtaacaaacaaagaatgaaggaagaaaaaatttttacaaacattcaacatatttttattttgaaataattttgtatttttccctatatcctacattggatcagaatattactgttatgtatagccatgaggacatggtctcaaaaaatgagaaactttcttagacagtaaaattgttaacttgagatgtttgcttccatcttctagagccaagtaggatctaactttaatttgacttagccaataatctgaaactattatagtatctgtctttcacagatacatgcaatattcacttctaaatatttaatgataaatttgtaatcatacatgatagtcaattttaatgattatgttgtcaaaattcaggctttttgtgtgaattgaagacttaaagaagaatttgtaaatatgactgtataagaaacaacagaaagatgaagatgaaccgaaatagaaatatcaagaggctacaaagtcttagcaaattataattgctaatggtacattatgtggtgtttagtatcacatttagaatgtagtcatttgttaagtttttcatggggtaaaagaaagaatttattccaagaaaattttggaattttaaaaataaacatgacatcttatcatgagaaa

SEQ ID NO: 169431 - DNA, 4784 bp, Homo sapiens
  Payload ID: 13364
  Gene Symbol: PRR27
  Gene Name: proline rich 27
  ENST ID: ENST00000509633
  CDS Start-End: 134-214
cttcctagacagactaaaaaagccatgtattctttcgtttctctctaaaagaagaaaaatataatttaaaaatacattgcgtattttctaaaacaataaatttatagtgttaatattcatagggtcaatcaaaatgaagcttctcctttgggcctgcattgtatgtgttgcttttgcaaggaagaatgctggattgggcttcctatggctgtgaagtgccattgctggagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtccctccttcaaggtttttttcagcagctgcagcacccgctgccccacctattgcagctgagcctgctgcagctgcacctcttacagccacacctgtagcagctgagcctgctgcaggggcccctgttgcagctgagcctgctgcagaggcacctgttggagctgagcctgctgcagaggcacctgttgcagctgagcctgctgcagaggcacctgttggagtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcttttccaaagactatttcattctgttgtattcagagtattcatctcactacattgatttgtttgtggtagtttttccttggacttaatttatattgaaaaaacattgataattaaataaataaaatagataatttagaccaatggtgataaggtctggatgaaaactacgctatggaggactgaaatggcaatcattcagcctagcctggagtctgattatacagctactataggatgatgttagtattggttttgagtgcaataggttttttcctaaacaaacatattttgtagtcaatgaactttttgtcacaaaacagtaaaacatctgtgtttaacctatggtaaacaacatgttaatgaactatgctatccatgacttaatggacagttcaaatgtgacatctacagtttttcatttctcttttatgccagcacacaatcaattcatcaccaattgtcatttgatttacttcaaaaaatatacccccaaatcctaatacttctaaccttctccactgcatctagccaactctagctattgtcatccctaacagaaatggaggaatagcctctttttttttttttttttttgagacgaagtctcacactgttgcacggctgtagtgcaatggtgccaactcagctcactgcaacttccacctcccgggttcaagtgattctcctgcctcagcctcctgagtagccgggattacaggtgtgtgccaccacgcctggctaattttttgtaatttagtacagacaggggttccctatgttggccaggatggtcttgatctcctgacctcatgatctgtccgcctcggcctcccaaagtgctgggaatacaggcgtgagccaccgtgccctgccagaatagcctattaaccagtctacctgcttccacttttcctccaccctgatcacatacacacatgcattatccactgagcagtcacaatcagatgttaaaccaaacattattcagataagatctctgaaaagcctctgatactttctcttttaaaatggaatatattctaaacacctctccaaggacacaagacttaccttgtctaactaatgacttttctaacttcattccctatcattctccatcttgccccatgctcctcatgcagcagcttttttttttttttcctttttcaaatatgttggttttgatcttatccaagaacctttgccctgatgtatgaatgactaactgcttttctacttcgggggtctcatatagaaatcctgcttcagaatactcttccctgagcactctatctaaataaatccctcttctgcaacccagtgctttttgttctattactgacttcttttccttgtagaagttactattactgctttttacctttttatttatttgtgtattgtctttgttgttgccctcatcttatctccacaaaaatatatgctccataaaaacaggcatttctgtgtcttattcagcactttatcagggcctataacaatgcctgggacatattcagtgaccagtgaatatttttggaaggaaagaaaagaagaaagaatgaagtaacaaacaaagaatgaaggaagaaaaaatttttacaaacattcaacatatttttattttgaaataattttgtatttttccctatatcctacattggatcagaatattactgttatgtatagccatgaggacatggtctcaaaaaatgagaaactttcttagacagtaaaattgttaacttgagatgtttgcttccatcttctagagccaagtaggatctaactttaatttgacttagccaataatctgaaactattatagtatctgtctttcacagatacatgcaatattcacttctaaatatttaatgataaatttgtaatcatacatgatagtcaattttaatgattatgttgtcaaaattcaggctttttgtgtgaattgaagacttaaagaagaatttgtaaatatgactgtataagaaacaacagaaagatgaagatgaaccgaaatagaaatatcaagaggctacaaagtcttagcaaattataattgctaatggtacattatgtggtgtttagtatcacatttagaatgtagtcatttgttaagtttttcatggggtaaaagaaagaatttattccaagaaaattttggaattttaaaaataaacatgacatcttatcatgagaaacatttacagtttttgcttttactacaagatactgtgaaatgttctgctctgtcagttgtgaaagtatgaaatttaagtctatcactacaataatattttgtttttagtgttcatttttttcctcctgactacattgagatgagttagattgagtgaaaggtaaacactaacatttgaattgaggtaatttccactgtggaaaacaaactgttgttagtaaacaggcatcagctttgagacacagaaaagtcatccaaaccagaagattgggaacttcctcaattactttgtcttccatttattgcattcaattagtcaaaaatgttgttaattatacattttaaagactatttttggtaaggtctatgacacattcaaaatactacatacaagtttgtattatcataaataatccaaaagaaaacatacatgtaaccaccaccatctggaaatttcacactaaattataaaacatttccatcactgcatgtattgtttaatgtcgctttatgaatccaccttcttccttatctgtagagttaaaaactacttagtggattagggtaattcattctacttttaaaaatgatttttccacctctaatgtattctataaaataatattgttcacttttgcctatttttgagctttttatagaaaaatgctactgcgaaattattttgagtcatatcttttgatcgatattaagatacatttgcagagttttgtatgtgtgtttatatccatcttacataattctttactgtatagcgttccctttagccactggaaaatgatataatgtcattgcttacagaaggtgactgattcttattcagtgctactttctacagacaggtaactattcgcatttacgattaagaaatgttcacaccttcacactggtatcaactgcaacaaccactatacttctccagtgattgccagatggcccactatacatcctttcttctatttctttcttttgtggccagaaagtcaggacctcaaagaggtataagtttgtgtgtataattccctggcttttttctaaaattttagtatgcatttatgtggcacttaatatataaaagagttttatgagttttaaaaatgtatataaacaagacatataataaatggtatgtcatttcacaatttactatttttactcaacatttatatttctgagacttttcacatttttgaatgtattcatagtttcactttaattgatgtttgccatgaaagatcaaatatatcacattttatttgactaaaaagtaaactatatttcctacattatgctatagaacttatagactaatttaagttaattataggccttatctcagacctttgcaagtagcctgaataaaacttttcattatttatattatcacatgcatatatgtgtgtatgtatatatgtgtgcatgtgcatgcatagtaaaaatcttaacccaaaactgaaataaaaaattataagagaaaatactattttccaccaatatcacaatggataatcttttttaaatgactacatatgtcgataagttacaaaatccatatatgagtatgacaccaataagaacattttctctaaccattttgaatacgaataaccatggattctaatagcaaacattattaaaatattattgaaa

SEQ ID NO: 169432 - DNA, 641 bp, Homo sapiens
  Payload ID: 13364
  Gene Symbol: PRR27
  Gene Name: proline rich 27
  ENST ID: ENST00000512173
  CDS Start-End: 1-185
ctgcagaggcacctgttggagctgagcctgctgcagaggcacctgttgcagctgagcctgctgcagaggcacctgttggagtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcttttccaaagactatttcattctgttgtattcagagtattcatctcactacattgatttgtttgtggtagtttttccttggacttaatttatattgaaaaaacattgataattaaataaataaaatagataatttagaccaatggtgataaggtctggatgaaaactacgctatggaggactgaaatggcaatcattcagcctagcctggagtctgattatacagctactataggatgataaggtgactgattcttattcagtgctactttctacagacagtggggagatgtttgatgcaactgtgattcattcagtgaagagcatttaaatgaccatgaatatgatcaaaacaacgttcatattaaacacctaactata

SEQ ID NO: 169433 - DNA, 3007 bp, Homo sapiens
  Payload ID: 13364
  Gene Symbol: PRR27
  Gene Name: proline rich 27
  Uniprot ID: Q6MZM9
  ENST ID: ENST00000502294
  CDS Start-End: 74-733
gaggcacattgtccacgtcaagaccaagagctgcatccactagtttgcaccctggaaacaagggtcaatcaaaatgaagcttctcctttgggcctgcattgtatgtgttgcttttgcaaggaagagacggttccccttcattggtgaggatgacaatgacgatggtcacccacttcatccatctctgaatattccttatggcatacggaatttaccacctcctctttattatcgcccagtgaatacagtccccagttaccctgggaatacttacactgacacagggttaccttcgtatccctggattctaacttctcctggattcccctatgtctatcacatccgtggttttcccttagctactcagttgaatgttcctcctctccctcctaggggtttcccgtttgtccctccttcaaggtttttttcagcagctgcagcacccgctgccccacctattgcagctgagcctgctgcagctgcacctcttacagccacacctgtagcagctgagcctgctgcaggggcccctgttgcagctgagcctgctgcagaggcacctgttggagctgagcctgctgcagaggcacctgttgcagctgagcctgctgcagaggcacctgttggagtggagccagctgcagaggaaccttcaccagctgagcctgctacagccaagcctgctgccccagaacctcacccttctccctctcttgaacaggcaaatcagtgaaattctctagaagagtaccatgggttcatttctatactgatgcagaaataagtgaaatctacaaaagttttctttcttttccaaagactatttcattctgttgtattcagagtattcatctcactacattgatttgtttgtggtagtttttccttggacttaatttatattgaaaaaacattgataattaaataaataaaatagataatttagaccaatggtgataaggtctggatgaaaactacgctatggaggactgaaatggcaatcattcagcctagcctggagtctgattatacagctactataggatgatgttagtattggttttgagtgcaataggttttttcctaaacaaacatattttgtagtcaatgaactttttgtcacaaaacagtaaaacatctgtgtttaacctatggtaaacaacatgttaatgaactatgctatccatgacttaatggacagttcaaatgtgacatctacagtttttcatttctcttttatgccagcacacaatcaattcatcaccaattgtcatttgatttacttcaaaaaatatacccccaaatcctaatacttctaaccttctccactgcatctagccaactctagctattgtcatccctaacagaaatggaggaatagcctctttttttttttttttttttgagacgaagtctcacactgttgcacggctgtagtgcaatggtgccaactcagctcactgcaacttccacctcccgggttcaagtgattctcctgcctcagcctcctgagtagccgggattacaggtgtgtgccaccacgcctggctaattttttgtaatttagtacagacaggggttccctatgttggccaggatggtcttgatctcctgacctcatgatctgtccgcctcggcctcccaaagtgctgggaatacaggcgtgagccaccgtgccctgccagaatagcctattaaccagtctacctgcttccacttttcctccaccctgatcacatacacacatgcattatccactgagcagtcacaatcagatgttaaaccaaacattattcagataagatctctgaaaagcctctgatactttctcttttaaaatggaatatattctaaacacctctccaaggacacaagacttaccttgtctaactaatgacttttctaacttcattccctatcattctccatcttgccccatgctcctcatgcagcagcttttttttttttttcctttttcaaatatgttggttttgatcttatccaagaacctttgccctgatgtatgaatgactaactgcttttctacttcgggggtctcatatagaaatcctgcttcagaatactcttccctgagcactctatctaaataaatccctcttctgcaacccagtgctttttgttctattactgacttcttttccttgtagaagttactattactgctttttacctttttatttatttgtgtattgtctttgttgttgccctcatcttatctccacaaaaatatatgctccataaaaacaggcatttctgtgtcttattcagcactttatcagggcctataacaatgcctgggacatattcagtgaccagtgaatatttttggaaggaaagaaaagaagaaagaatgaagtaacaaacaaagaatgaaggaagaaaaaatttttacaaacattcaacatatttttattttgaaataattttgtatttttccctatatcctacattggatcagaatattactgttatgtatagccatgaggacatggtctcaaaaaatgagaaactttcttagacagtaaaattgttaacttgagatgtttgcttccatcttctagagccaagtaggatctaactttaatttgacttagccaataatctgaaactattatagtatctgtctttcacagatacatgcaatattcacttctaaatatttaatgataaatttgtaatcatacatgatagtcaattttaatgattatgttgtcaaaattcaggctttttgtgtgaattgaagacttaaagaagaatttgtaaatatgactgtataagaaacaacagaaagatgaagatgaaccgaaatagaaatatcaagaggctacaaagtcttagcaaattataattgctaatggtacattatgtggtgtttagtatcacatttagaatgtagtcatttgttaagtttttcatggggtaaaagaaagaatttattccaagaaaattttggaattttaaaaataaacatgacatcttatcatga

SEQ ID NO: 169434 - DNA, 3007 bp, Homo sapiens; identical to SEQ ID NO: 169433
  Payload ID: 13364
  Gene Symbol: PRR27
  Gene Name: Proline rich 27
  ENST ID: ENST00000634530
  CDS Start-End: 74-733

SEQ ID NO: 169435 - DNA, 3127 bp, Homo sapiens; identical to SEQ ID NO: 169430
  Payload ID: 13364
  Gene Symbol: PRR27
  Gene Name: Proline rich 27
  ENST ID: ENST00000634325
  CDS Start-End: 190-849

SEQ ID NO: 169436 - DNA, 641 bp, Homo sapiens; identical to SEQ ID NO: 169432
  Payload ID: 13364
  Gene Symbol: PRR27
  Gene Name: Proline rich 27
  ENST ID: ENST00000634747
  CDS Start-End: 1-185

SEQ ID NO: 169437 - DNA, 4784 bp, Homo sapiens; identical to SEQ ID NO: 169431
  Payload ID: 13364
  Gene Symbol: PRR27
  Gene Name: Proline rich 27
  ENST ID: ENST00000635689
  CDS Start-End: 134-214

SEQ ID NO: 169438 - DNA, 1266 bp, Homo sapiens
  Payload ID: 13365
  Gene Symbol: PRR29
  Gene Name: proline rich 29
  Uniprot ID: P0C7W0
  ENST ID: ENST00000425164
  CDS Start-End: 15-725
aaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccaggattcagcactgtcctgcctccagggaaagggagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctgagcagagtcagttcgctgggccccccacccctcatcccaggaagcagctctgttggcagaaaggagaggtcagagctttgtcctgctgtggccaggagtggcctgaggtctcctggggccaggtgggaacagtgtgtcctctgccccctgggccagggtgtgtttcccccaccctccctcagtagcaatgagctactcgggccagatgggggcctgttgcatgggctgggaggcccctgtgaaggagagggtggggagggaggcat

SEQ ID NO: 169439 - DNA, 3127 bp, Homo sapiens
  Payload ID: 13365
  Gene Symbol: PRR29
  Gene Name: proline rich 29
  Uniprot ID: P0C7W0
  ENST ID: ENST00000412177
  CDS Start-End: 15-584
aaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccaggattcagcactgtcctgcctccagggaaagggaggtgagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctgagcagagtcagttcgctgggccccccacccctcatcccaggaagcagctctgttggcagaaaggagaggtcagagctttgtcctgctgtggccaggagtggcctgaggtctcctggggccaggtgggaacagtgtgtcctctgccccctgggccagggtgtgtttcccccaccctccctcagtagcaatgagctactcgggccagatgggggcctgttgcatgggctgggaggcccctgtgaaggagagggtggggagggaggcatctagggagaggggtcccccatggtggctcccctccctggccattgttatcccaggaggagacactgtgggcacagggctaagtccaggtgtttgtattcgggctagaaaaggcaatgtcccaagtctctgctgcctgtcacagtccttcagccagggctggacctcaaccctgaggagtcacactgagttccagtgaccaccgtggtggtggccatgccactcatggttgctatggccggaaggcctggggcagcctcctccaagccgctcgcaccccgtaggtgcccatccgctgctggcgcaagtgctggccgaagatgaagcagagcaggacagatgtcacgaacagggacagcaacaccgacaccaccgtgactatgatgaccatctggctgtccgacacaggctctggggagggagggggcaagggtcttagacgtcctgtgatcccagttaccagggaccaaaagggagtggaagtccacccccaacccagacccccagaccccgccgcccgctcatgcatccagcagtcaccccagttgcagagatgagtggtgaatggtgtctgcattaaaattattatctggaaaaaaggtggcccagggctcaggctaccagctggacttctgtgtggctgtgagggcagatgtccccttgtcagcagccatgggaccagtgtgtagctgctggacaccgtggcctggagggtggcatggtcccagccaagccccttcttgggcagagctgagtgaacttcatgccaggctccctgtgtgccggccgtccagggtcaccaagcagcagagctctggggacctcagtgggggcagtcaggccaaacttctcattgtggaggggagccaaggccagggagagccgtcaaggtcatggggcttgatggtggccgaggaactagttgacctctcccgacctctggagcagttgaggtccaagctggggacttggaaagaacttcagggaagagggagagtaagagggaagcctcaggatgaagggtgggctcctgggtgtttgcttcccaagtgggactcaagatttttcttcccccgaggggctgaaagtgacttatcactcccaactccatccacggatcccccctcaccatagatctccaacatcttcggggctgagtgtttgtgaaagatgttgccaccgcgagacatcaagtccagcacagccaggcaggagaagttgcggtggccatcctctctgtcagccgtgctgttgaatgtggctgtggcctcctgcggagcaggggctgccttcccgaaggtctcatagtgcagagtctcattgccacggaacaggaagagggtgaggctgtccaggggctccacggtgggcaccctgcactcaatggtgaaggacttgcccacagccaccaaagtgggttgcagtgtcaggatgacctgccttggaggctctgcaggggacaaaggagggaggtctggtcaggatgggggtgcagtcccagcagcctccccctggccagggccatctcctgtcaccatggtgttccacggttggggaggaggtggcctggccggctccagtgcagagaggaagagggcagcagttgaggatggaggctggactgtgtggtagttttacagacatgatggtttccggtgaccaggtgtctacaaggacaaggttcagaaattgtacagccaactggaaagatataaaagtttgggtctgtctcctctccttcagaaatgaaatataaatttcaaacattaaacagttgggtgatcacgttg

SEQ ID NO: 169440 - DNA, 458 bp, Homo sapiens
  Payload ID: 13365
  Gene Symbol: PRR29
  Gene Name: proline rich 29
  ENST ID: ENST00000580752
  CDS Start-End: 11-124
ggcgccagccatggcctctggggcgggcggaagctggggtcgctccccaccgcagagcgcagtcccgacggagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggag

SEQ ID NO: 169441 - DNA, 1052 bp, Homo sapiens
  Payload ID: 13365
  Gene Symbol: PRR29
  Gene Name: proline rich 29
  Uniprot ID: P0C7W0
  ENST ID: ENST00000579184
  CDS Start-End: 15-563
aaccggcgccagccatggcctctggggcgggcggaagctggggtcgctccccaccgcagagcgcagtcccgacgcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccaggattcagcactgtcctgcctccagggaaagggaggtgagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtcggggagagactttgctgggcagcgcccctg

SEQ ID NO: 169442 - DNA, 478 bp, Homo sapiens
  Payload ID: 13365
  Gene Symbol: PRR29
  Gene Name: proline rich 29
  ENST ID: ENST00000583891
  CDS Start-End: 11-478
ggcgccagccatggcctctggggcgggcggaagctggggtcgctccccaccgcagagcgcagtcccgacgcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccaggattcagcactgtcctgcctccagggaaagggagactactatgatgccgagagcc

SEQ ID NO: 169443 - DNA, 565 bp, Homo sapiens
  Payload ID: 13365
  Gene Symbol: PRR29
  Gene Name: proline rich 29
  Uniprot ID: P0C7W0
  ENST ID: ENST00000577953
  CDS Start-End: 15-311
aaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgtt

SEQ ID NO: 169444 - DNA, 967 bp, Homo sapiens
  Payload ID: 13365
  Gene Symbol: PRR29
  Gene Name: proline rich 29
  ENST ID: ENST00000582540
  CDS Start-End: 92-508
aaccggcgccagccatggcctctggggcgggcggaagctggggtcgctccccaccgcagagcgcagtcccgacgacctgctggaactgatgatgctgcagaacgcgcagatgcaccagctgctgctgagtcgcctggtggctggagcgctgcagccccggcctgcctcgccctgccctcaggtctacctggaggttccacaggaagagcctgaggaggaggaggaggagatggacgtgcgggagaaagggcctttggtgtttcaccaccactacttgccctatttgatgccctccccgggtgccctgctgccctggccagcccccttcttccccacccctgcttgtcagccctacttgcaggacgtgcccaggattcagcactgtcctgcctccagggaaagggaggtgagagctgtgcccccacccccaccccccagtgccacagggactgtgggtgctgatgtacccccggcttcagactactatgatgccgagagcctcctatgaggacagaccccggccctgggaactgcaccagcttcctgctctggatacagccccggagccgcctcctgcacctctcttgtcgactccccggtgcccatggctggcagtccttctcactccctcaacctcagccaggccctcttctcctggggaaatcagtccctgccccacgccaatgagttcctggacgggccggatctgtgctgttgtgtaagagctccctagagcaccacccaggcccttgaagccacgtcagcccgcctctgccccactgcttcctgcctggagcagggggaggcctgggaacagagcccccaccctctctccctcacccctctctctgggatgatgaggtctccttccagcctagtaatggagcaagaggggagggggggattccttctgctttccacagctttgaaggcccctttgaggtggctggaggggcccagagtggtc

SEQ ID NO: 169445 - DNA, 1797 bp, Homo sapiens
  Payload ID: 13366
  Gene Symbol: PRR3
  Gene Name: proline rich 3
  Uniprot ID: P79522
  ENST ID: ENST00000376557
  CDS Start-End: 66-569
agaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccatccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgcctttgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaa

SEQ ID NO: 169446 - DNA, 2254 bp, Homo sapiens
  Payload ID: 13366
  Gene Symbol: PRR3
  Gene Name: proline rich 3
  Uniprot ID: P79522
  ENST ID: ENST00000376560
  CDS Start-End: 460-1026
aacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccatccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgcctttgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaa

SEQ ID NO: 169447 - DNA, 2254 bp, Homo sapiens
  Payload ID: 13366
  Gene Symbol: PRR3
  Gene Name: proline rich 3
  Uniprot ID: P79522
  ENST ID: ENST00000383592
  CDS Start-End: 460-1026
aacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaa

SEQ ID NO: 169448 - DNA, 2254 bp, Homo sapiens; identical to SEQ ID NO: 169447
  Payload ID: 13366
  Gene Symbol: PRR3
  Gene Name: proline rich 3
  Uniprot ID: P79522
  ENST ID: ENST00000454399
  CDS Start-End: 460-1026

SEQ ID NO: 169449 - DNA, 1797 bp, Homo sapiens; identical to SEQ ID NO: 169445
  Payload ID: 13366
  Gene Symbol: PRR3
  Gene Name: proline rich 3
  Uniprot ID: P79522
  ENST ID: ENST00000444972
  CDS Start-End: 66-569

SEQ ID NO: 169450 - DNA, 2254 bp, Homo sapiens; identical to SEQ ID NO: 169447
  Payload ID: 13366
  Gene Symbol: PRR3
  Gene Name: proline rich 3
  Uniprot ID: P79522
  ENST ID: ENST00000432371
  CDS Start-End: 460-1026

SEQ ID NO: 169451 - DNA, 2254 bp, Homo sapiens; identical to SEQ ID NO: 169446
  Payload ID: 13366
  Gene Symbol: PRR3
  Gene Name: proline rich 3
  Uniprot ID: P79522
  ENST ID: ENST00000449754
  CDS Start-End: 460-1026

SEQ ID NO: 169452 - DNA, 1797 bp, Homo sapiens
  Payload ID: 13366
  Gene Symbol: PRR3
  Gene Name: proline rich 3
  Uniprot ID: P79522
  ENST ID: ENST00000422639
  CDS Start-End: 66-569
agaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaa

SEQ ID NO: 169453 - DNA, 1797 bp, Homo sapiens; identical to SEQ ID NO: 169452
  Payload ID: 13366
  Gene Symbol: PRR3
  Gene Name: proline rich 3
  Uniprot ID: P79522
  ENST ID: ENST00000442290
  CDS Start-End: 66-569

SEQ ID NO: 169454 - DNA, 2254 bp, Homo sapiens; identical to SEQ ID NO: 169446
  Payload ID: 13366
  Gene Symbol: PRR3
  Gene Name: proline rich 3
  Uniprot ID: P79522
  ENST ID: ENST00000427729
  CDS Start-End: 460-1026

SEQ ID NO: 169455 - DNA, 1797 bp, Homo sapiens; identical to SEQ ID NO: 169452
  Payload ID: 13366
  Gene Symbol: PRR3
  Gene Name: proline rich 3
  Uniprot ID: P79522
  ENST ID: ENST00000418065
  CDS Start-End: 66-569

SEQ ID NO: 169456 - DNA, 1797 bp, Homo sapiens; identical to SEQ ID NO: 169445
  Payload ID: 13366
  Gene Symbol: PRR3
  Gene Name: proline rich 3
  Uniprot ID: P79522
  ENST ID: ENST00000436805
  CDS Start-End: 66-569

SEQ ID NO: 169457 - DNA, 1797 bp, Homo sapiens; identical to SEQ ID NO: 169452
  Payload ID: 13366
  Gene Symbol: PRR3
  Gene Name: proline rich 3
  Uniprot ID: P79522
  ENST ID: ENST00000422140
  CDS Start-End: 66-569

SEQ ID NO: 169458 - DNA, 2254 bp, Homo sapiens; identical to SEQ ID NO: 169447
  Payload ID: 13366
  Gene Symbol: PRR3
  Gene Name: proline rich 3
  Uniprot ID: P79522
  ENST ID: ENST00000453232
  CDS Start-End: 460-1026

SEQ ID NO: 169459 - DNA, 2008 bp, Homo sapiens
  Payload ID: 13367
  Gene Symbol: PRR30
  Gene Name: proline rich 30
  Uniprot ID: Q53SZ7
  ENST ID: ENST00000335524
  CDS Start-End: 527-1765
agctcccattggggtcggcgaacctggtgccaccccttagacaaagtcccagtctcccagaggcttttaccagctggccccattccttctgctgctgggtataataaggtcctctcaacgctgaagtgcctgtgaaacacagcccagaggagttctcattggtcctatgggctttgtcttcctctctgccccacccagataatcgctgctgcccctccactcccaagatgcagctgtgattctccatccccacacatccctcatcaatggttgactgcaaagaagtgagaagccaagcttagattcatgctcatgcctgaacaccctgagagcctggtgctggagggctgggtatccccttggcctgccaccagcacctgcacccacaccaggctggagccacgctctgcgcacagaaggtggccttgatttctcaggcacagctgacctcagagatactggtcctgactctgccaggtctcttatccctagtcttgttgccccagttccttctggattcaaggcgatgttgcctcaaaacaaggaccaggtgctgccacagacctcagtgctccctgggcgccccacttggggcttctcacaacttgtggactcctctcctcacaacctacagcctctctctccccatcagggcctccctccctctcaaccaccgttctcttccactcagtcccgtcgtccctcctcccctccaccagcatccccctctcctggcttccaattcggctcttgtgactcaaattctgactttgctccacatccctattctccctctctcccaagttcccctactttctttcaccagaactacctctctctcccccgtccacgtgcatcctctccctccaaccactggctgtacccctctccccctctgaccccttccttttctccctcccagcctcagaactcctcccttccccactcaccttgccagtccccttcccaccccgaggaactgcatagctccacactcacttccccaggccccagcccaccttctcataggctccactctaacaggcagacatggcgctggcatcagtacagggacactgggtccgggtcccctggagtggtggagagatgcgtgccaagcgagaaggatcctgcacagttcagggacccaggggccctggcccaggccctggtggtccagctggggcaccgccgcatcgcacacgacctgcggctactgcttttgcagcacctgtggctaggcagaaccggccaggccccagtcgtggagtatcctatatgcctggtgtgcctccggccccgcagcccctcctgccccctccccaggtacaggactggaccccggctgcttgctttccctcaactactgccctgtgtgcagggccaggaatctgggccactccggataggcatcggcttcggcctccgcctgcctcagggccaggccagggccttgcatctgctgcccgagaaaaggccgaaggaagcagggcctcagggcaaggctactcaggcctgtgggcatcaattgccagcatctcagcctccagcagctcaggcccgggccgacccagtcccaggcacaccctcccagaccaggagcttcaggtctgcaggccttcaatcaccaaactccccacgatgtttctccgggcctccacctcgggcaccaaaacaggtcactacctccctgaagcccaggccttgccctggcccaaagaggccagtttctctggagctcattctccaaaagtcatcagtctagttccagagccacggaggccccctggaacaccccctccaaacccaaccctcccaaccaggccccagatctcggggagtccccgagacaccctgaagggctggctggccggaggtcaggtgtgttctcctgctctgaaccctgggagccccttgtggagtctgctgtctccaggctgaagaggaccaagggcaccaaggccccattcagccctccgtgtatctaataaagtctgaccctgtgaaa

SEQ ID NO: 169460 - DNA, 832 bp, Homo sapiens
  Payload ID: 13367
  Gene Symbol: PRR30
  Gene Name: proline rich 30
  ENST ID: ENST00000432962
  CDS Start-End: 520-832
attggggtcggcgaacctggtgccaccccttagacaaagtcccagtctcccagaggcttttaccagctggccccattccttctgctgctgggtataataaggtcctctcaacgctgaagtgcctgtgaaacacagcccagaggagttctcattggtcctatgggctttgtcttcctctctgccccacccagataatcgctgctgcccctccactcccaagatgcagctgtgattctccatccccacacatccctcatcaatggttgactgcaaagaagtgagaagccaagcttagattcatgctcatgcctgaacaccctgagagcctggtgctggagggctgggtatccccttggcctgccaccagcacctgcacccacaccaggctggagccacgctctgcgcacagaaggtggccttgatttctcaggcacagctgacctcagagatactggtcctgactctgccaggtctcttatccctagtcttgttgccccagttccttctggattcaaggcgatgttgcctcaaaacaaggaccaggcagacatggcgctggcatcagtacagggacactgggtccgggtcccctggagtggtggagagatgcgtgccaagcgagaaggatcctgcacagttcagggacccaggggccctggcccaggccctggtggtccagctggggcaccgccgcatcgcacacgacctgcggctactgcttttgcagcacctgtggctaggcagaaccggccaggccccagtcgtggagtatcctatatgcctggtgtgcctccggccccgcagcccctcctgccccctccccaggtacagg

SEQ ID NO: 169461 - DNA, 1228 bp, Homo sapiens
  Payload ID: 13368
  Gene Symbol: PRR32
  Gene Name: proline rich 32
  Uniprot ID: B1ATL7
  ENST ID: ENST00000371125
  CDS Start-End: 81-977
gtcatttctccagacctagctggcctgttcagtgggttatctccaccacctcaggaaagctattctgatcaaatttcttcatggcttgtattgaaaacgtccttggagggcacgccccttcacccttggtagtatctgtggacaaaaatgggaaccaggagctgcaccacgacatgcccctgcaatgtctgagttccaagccagaggatgacgcagagccctggggtcaacctcaagtaccgctgagaccttccgtcaatgtgctgactgatctggatagcaagcaactggagtggccctctgaaagaacaggatcctgcattcctcttcatagcttgagagctcatagacacccctacgggccaccacctgctgttgcagaagagtccctagcaacagcagaagtaaacagctctgatgcactggcaggctggaggcaggagggacaggatgctattaatgtgtcctgggaagtctctggcggccctcctgcactgatagtagggggcacaaaggtcaacaatgggggcactgagagaggcagtaataacgcaaggttgcatgtagctttgccacaaggtaaagggttctttccacccaggggcccacaagtgagaggcccttcacatattcccacccttagatcagggatagtaatggaggtgccgcccggaaatacacgaatagcctgcagaggaaagctggctcatgtttctttcccactcaggggcccatgccaccccatgcataattggccaaggcctatcccgttgtcttccagtactccaggtttaccttcttgctctactgttcattgtttcatccctcctcgacctccgattttcaatccctttctcactatgcctcttccttttgctcctcctccgatatttggtcctccactgccttcttattttgcccatttccattctgggggaatgccagctcctgcatcacccaacagagagcacagctgatggcaaaaaggaaggatgaaaaaagggttgtggaaagaggtgaaagttattcatttatgcttttatatttgaaaccttgtaccctcccacactctgtttagcactaatgtgccctacttgaaaccacgtaccctcccacactctgtttagcactaatgtgccctatttgaaaccttgtaccctaccacactctgtttagcacaaatgtgccctacatactggagattaaataaagattgtgaagtctgaaa

SEQ ID NO: 169462 - DNA, 1710 bp, Homo sapiens
  Payload ID: 13369
  Gene Symbol: PRR33
  Gene Name: proline rich 33
  Uniprot ID: A8MZF0
  ENST ID: ENST00000391480
  CDS Start-End: 271-1710
ggaggcaggttctagccccatccctggagggactcggcctctgtggcctcatttctacactagggtgatggtggggccaccccaaagtccccaaggcacagtcgagctcagcatgtccctggcaggttctgggtgctcaggaagcagaatactcaggcctccacacccctggccccaggtcctccttggaccacaggagacacaggcctcccacctcaggagggaggagggctggcctgaccactgtccctcccaccctaggacacagtcatgctcatatcggctgcgtcgatggcacccgaggtgtgcggcccaagcctccagggaacccctggacccccaccgcccctgctgcccaagccagggaaggacaacttgcgtttgcagaagctcctgaggaaggcagcccggaagaagatgatgggaggcacacacctcgctccacccagggccttccgcacctccctgtcccccgtgagtgaggccagccatgaccaggaggtcacagccccgcacgctgctgagggcccgcaccccgccgaagccccacgccttcctgaagccccacgccccgccgaggctccccgcatggtggctgccctaccccgctccccgcacacccccatcatccaccacgtggcatcacccctgcagaagtccacgttctccatcggcctcacccagcgcaggattctagctgctcaattcagggccatggggccccaggttgtagcctcggccccagaacctacccggccccccagtggcttcgtccctgtctctgggggtgggggcacccacgtcacccaggtgcacatccagctggcaccatccccacacaatgggacccctgagcctcccaggacagccccagaagtgggatccaacagccaggatggagatgccaccccaagtccccccagggcccagcccctggtcccagtggctcacatccgcccactgcccaccacagtccaggctgccagtcccttgcctgaggagccccctgtaccacggccgccacccggcttccaggcctcagtgcccagagaggctagtgccagggttgtggtgcccatagccccgacctgccgctcgctggagtcctcaccgcacagcctggtccccatgggccctggcagagagcacctggaggagcccccgatggctggccccgccgctgaggccgagcgagtgtccagccctgcctgggcctcatcccctaccccaccatcaggccctcacccatgccctgtccccaaagttgcacccaagccccggctcagtggctggacgtggctcaagaagcagctgctggaggaggccccagagcctccgtgcccagagccgcggcagagcctggagccagaggtgcccacccccacagagcaggaggtgcctgcccccacagagcaggaggtgcccgccctcaccgcaccccgggcccccgcctcccggacctccaggatgtgggatgccgtgctgtaccgcatgtcagtggcggaggcccaagggcgcctggcagggcccagcggtggggagcacaccccagccagcctcacccgcctgcccttcctgtaccggcctcgcttcaacgcccggaagctgcaggaggccacccggccccctcccacagtccgctccatcctggagctgagcccccagcccaagaacttcaaccgcacagcgactggctggaggctccagtga

SEQ ID NO: 169463 - DNA, 2817 bp, Homo sapiens
  Payload ID: 13370
  Gene Symbol: PRR34
  Gene Name: proline rich 34
  Uniprot ID: Q9NV39
  ENST ID: ENST00000396008
  CDS Start-End: 52-468
acacgcgtcctcccctcggcggggaggccggctaggggcaggcgggcagcgatgcctgcgtcggccacagctgcctggcactgccctcctttgtgcctgcctcctctgccagcctccgctccaacctccccccccaaccccgcaacgaggcctgctcctgggcccggccgcagggcccgttgcccacagagcgcccaccctgcgcccacccggggtgccctcaccttctgggcccctggctcctggcctcgggtcctgctggtgcccaggtcgcccggccccgtcctccgtgctccgcgtttgccccaccctgctgcccgagctcggcggcgagcctggcacggtgccaggctgcctgggagcccagcccgggcagggcgaactttccagcgagggttggtctcaaactcctgggctcatgcaatcttcctgcctcggcctcccaatgtgctggaattacaggtatgagctaccgcgctcagcccaaacccagggctcttaaccaccctactatgtactgtgctggcccccggtcaagggagagaactcacgtcaggcaaaaatgttttacagagaggcagctaagtcttttccacagtggatgacacagtccccctcacaaaccaccccacagatccaaccccaaggaactctgcttctacgtgtgcccttggggcaagggatgcaaagcaccaggcgatggagctcagaggatggcactcttccagagagctgtgtgtctctgggaaagctaacacacctctctgagcctgttgctacagctttaccatcagcgatgtgactgcaagccttctcagctgcctgtcagcagatgcacaggcctgtgcacagagctctgcggagaccacgccgacatcgccgcacacccaccctcctgctcatgggacagaccattcacacctgcttcaccaccagccacaggcttgtcggaaggagcagactcttctccacggacaagccactgcccctttgagggcctcagcttccttaccctatgagatgaggaaacagatcttcacttgccacaggacttggggggatgaaaaggtaacctccgtaaagctgcccctggtgtggggaagccaccccatagatgacattgcccgccctccccctaggcccagagctctacagagtcctcaagctggtgtccctccaggctaaaacacttccaccccctgggcagtgcactacagggtggtggggaaggggccatctgtggaagaaacacagggcctggcctggggtcctgggcaagacctctgtgacctcagtttccccagatccctccaggtgtgaccttgtagatggcctctattctggattcacagctgctgaggaggaggaagaggacactgaaggcattccttcagtcccctggggaggttcagatgctcagactccctgataccacctttcctgggcagaataaagtccccaagatgtccaagccctaatccctggagcctgggaaagtgttacctcccagaccaaagggactttgtaggtgtgtgattgagttgaagatctgcagtgagagggtagcctggattagccacgtgtgcccaaaagcagagactccttcccagccgtggtcagagacagaacaaggggacgctgctggctttaaagacggaagaagggacgaggagccaaggagtgcaagtgccgccagaggccagaaaaggcaagggatggatttttcccctggagttccaggaggaaccagccctgccaacacctggattttagttctgggaccccacctcagacatctgacccccttgactgtaaggtaataaatgtgcgttgcttaagccactgagtcagccataagttgttacatggctgccacaggaaactaacaggccctcccctctggccccaacatgcccagctgcctgtgaaggggaagaaggatggcacaaggcacggccctcatcgatgtgttcacacaccttgctcccctactgagctggccctggggctgcagacctgatccctgctctcaggagccttcgccagctgagagacgcccgcagagcctcccctccactgcggaggctcgaaccttccctcctgctgctgctgccccatcctctcctcttcctcctgctgctgtttgttgagtgctccctgtgagtaggcaccaggctagtgtcctcctcccaaccccagcctcataggctcagcggtcaggccacccgagcagtcacattgtagacccctgaatcctgcccatggtttggcaggacaaagggccttttctgcttcagagtcacaaatgtgtcctcctcacaataagggtggcatggaggtccctgggccagtgcctcagcctattgagcctggggtccttgtctgtacagggggatgaaggtagcacctcacagatggcgataaacccagccagtgcagggcaggcagtcagcgctccaaactcgcttcaagtctttgcctatgctgccaatcaagtcagctgtgggaagagtcaggtttttctcttgaaagtcagggccgggcacggtggctcatgcctgtaatcccagcactttgggaggctgaggtgggtagatcacaaggtcaggagaccgagaccatcctggctaacacagtgaaaccctgtctctactaaaaatacaaaaaattagccgggcatggtggcacgcacctgtagtcccacctacttgggaggctgaggcaggagaatcacttgaacctgggaggcagaggtttgcagtgaaccgagatcacgccactgcactccagccctggacgacagtgagactctatctc

SEQ ID NO: 169464 - DNA, 2216 bp, Homo sapiens
  Payload ID: 13371
  Gene Symbol: PRR35
  Gene Name: proline rich 35
  Uniprot ID: P0CG20
  ENST ID: ENST00000409413
  CDS Start-End: 280-1995
gggacgcgggcggcggcggaggctgcgggagtcgctgccgctcgagggaccgcggacccgggaggtccggctcccggcgccgggcctcagtttcccccacgggagccgcatcccacccccagagccccagcgcgtccgcggggtccgagtcgcggccggcgcggggcggggaggggcgggaagtttgcgccctacacgcggcctcgcagacttggcggctccgctcccggccgggcgcaggtggccatggtgcccggccctgcctcatagcaggctgccatgtcgcgggaggcgggctcatgccgcgtgggcacaggggcgagggcgcggtctcggaagcccaagaagccacactacatcccgcggccctggggcaaaccctacaactacaaatgcttccagtgccccttcacctgcctggagaagtcacacctctacaaccacatgaagtacagcctctgcaaggactccctgtccctgctgctagactccccagactgggcgtgccgccgtggctccaccacgcctaggccccacgcacccaccccagaccgccctggggagtccgaccccggcaggcaaccccagggagcacggcccacaggtgctgcccccgcgcctgacctcgtggtcgccgacatccactccctgcactgtggcggaggccccaagtccagggccaaggggtccccagggccaccaccccctgtggctagggccacccggaagggtcccggccccagtgggctcctgcctgagtcgtggaagccggggatgggaggggacccaaggggcgtgggtgcgggggacatggcctcagcaggccctgagggcagcgtcccctgctatcccccgcctgccccaggggagttccctgaggcccacagcctccacctgtctctgctgggcgtcaactacccgctcagccccggcctcttctcctacttggggccctcactggccgctgcagcccatgtgcccttcctggcctcggccagccccctgctgcccccggccacggccttcccagccgtgcagccccctcagcgccccaccccggccccccgcctgtactacccgctgcttctggagcacactctggggctgccagcaggcaaagctgcccttgccaaggcccctgtctcccccaggagcccctctgggactccggctcctggcctgctgaaggtgccagttccagggctggggccctggccccgagtcacccccagggacccagggcaggagggggagctggagcgggcagcccagagtgaccccaggaggaggctgtccctgggaagcaggctggagcttccgaaggcatcccccagcctgacaaggttctgttcccggagcagcctgcccaccggctcctctgtgatgctgtggcctgaggacggggatccaggcggccctgagacccccggccctgagggccccctccccctgcagccacggggcccagtgccaggaagcccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatgaccctgtcattcctggcagtggctggggcacctgtgttgcgacgaggagttcccagacccctgaggctgtctgtggcctgcagagcccccagggcgccgaggtctgacctgcagcgcctgaggtctgactgtctctgcctgcagcatgccggcccctctcctgcagcccctgcccctcacctgcctgggacctgccccgcctccgcatgcatgtggatagacccccacgggccgtggccaacgcttgtccctggggccacacagggacactggaggtcacagttatttattgatcacaattgtggacattaaaacagaaactgttcac

SEQ ID NO: 169465 - DNA, 4456 bp, Homo sapiens
  Payload ID: 13372
  Gene Symbol: PRR36
  Gene Name: proline rich 36
  Uniprot ID: Q9H6K5
  ENST ID: ENST00000618550
  CDS Start-End: 102-4142
ctcgcctcctcgccgctggcggccaccgcgtcgctccggcccgggccccaccccaggcgactctgtgaggagcggccggaggccggaggcggaggtgcaagatggacaacaagagagacaaggcgaaggcaggggccgccgcgcggacgccggctgctcgcgctcctggacttctgacccccaggcccccaggctctcctcgaccccctcccccagtaactcccgcagccctccgagttctgggagctgcgggagcagtggggcgaaagcctctggcagagcgagcggggggcatcggcggggccactattcccgagtctgctccccgagcgggaccaacgcggagtgctgggacaagttcccgaaaccctgcctccaggcccccagcctctgggagaggggagagagctcctcctgccaagaacaccagcccaggccctgtttctagcccagggcgtgccagcgggaccaccaggccaggccctcttggccagaagggactccggatctcagcggaggaaactgtggccagaggaaaagctacagaggctcccaaaaggagtgccctcagcgctggggcacggagagacacttccgggcctaccccaggaaccccgtccccggccatggcccgtcggtcccgggctgcgggcaccgaggtggggctcccccggccagctccgagtgcccggccacggcccccgacagagggcccccggaaatcagtgagcagcgcctcggagcacagtaccaccgagccaagcccggctgccaggaggcggcccagcgccggtgggggtctccagaggccggcctcgcgctccctgagctccagcgccacccctctctcctccccagcccgttctgggccctcagcccgcggaacacccagggctcctgcgcatccctcgcagcccaagccgaaaggactgcaggctctgcgaccccctcaggtcacacccccaaggaaggacgcagccccagcactaggaccgctttcttcctctcctttggccacaccctctccatcgggtaccaaggcaagacccgtaccgcctcccgacaatgcagccactcccctgccagccacgctccctccctctccaccggtaacgccccctccgccagccgctctccaaagtcaggccccgcccaccctgccggccacgccccactcgtcgagccttacctgtcagttggccacgccccttcctctagcccctccttctccctctgctccaccttctctgcagaccctcccctctccaccagccacgcccccctcgcaagttccacccacacagctgattatgtcctttccagaagcaggcgtctcttccctggccacagccgcttttgtggcttcagtctctccatcagtttcatcccctctgcagagtatgccccccacccaagctaatccagcgttgccctctcttccgactctcctctctcccttggccacacctcctctgtcagccatgtctcctctacaaggccctgtttctccggcaacatctctggggaattcggcttttcccctggccgcactccctcagccaggcctttctgctctgaccacgccccctccgcaggccagtccttccccgtctccgccctctctccaggccacgccccacactctggccactcttcctctgcaggactctcctcttctggccacattgcctctgcaggcctctccctctcctttgaccacagtctctctgcaggatcctcctctagtttctccctctcttttggcctcaccgcctctgcaggctccgccccacccacaggccccaccttctatgactacgccccctatgcaggccccgccctctctccagaccattcccccaatacaggtcccacattctctgacctcaccgtctctgcaggcacctccctctcctctggctttgtcctctctgcaggccacaacttctttgggctcacccactctgcaggccacacattctttcctgacaatgtcccctaggcaaacccaagcttctttgatctcaccttctcggccggcctctactccccctgattcaccccctctgcaggcccctctttcccttcctgcctcaccccctctgcagacttctctctctcctgctgtctcacccctaagctcacccctgaccatacaccctctgcaggcgctatcttctctggcctcccactctcctcaggcacctctctcttccctgatcatgccccctctggagacccaatcttccctagccccaccctctctgcagacacctcctgcttccctgaccacaccccctctggagaacctaccttctctagccccgcctcctctgcagacagcttctgctcccctgaccacaccccctctggagaacctaccttctctagccccgcctcctctgcagacagcttctgctcccctgaccacaccccatctggagactccaccttgtccagccccatgccctctgcaagcaccaccttcgccattgaccacgccccctccggagacgccctcttccatagccacgcctcctccacaggccccacctgctctggcctcaccccctttgcagggcctgccctctccccctctgtctcctttggccacgccccctccacaggccccacctgccctggccttgcctcctctgcaggcccctccctctccccctgcctcaccccctctgtctcctttggccacaccctctccacaggccccaaatgctctggcagtgcaccttctgcaggcccctttctctccccctccctcacccccagtgcaggcccctttctctccccctgcctcacccccagtgtctccttcggccacgcccccttcacaggccccaccctctctagccgcacctcctctgcaggtcccaccctctccccctgcctctcccccaatgtctccttcagccacgccccctccacaggccccaccccctctcgctgcgcctcctctgcaggtcccaccctctccccctgcctctcccccaatgtctccttcggccacgccccctccacgggtcccaccccttcttgccgctcctcctctgcaggtcccgccctctccccctgcctcactcccaatgtctcctttggctaagccccctccacaggccccacctgctctggccacacctcctctgcaggcccttccctctccgcctgcctcattccctgggcaggcccctttctcaccctctgcctcactcccaatgtctcctttggccacgcctcctccacaggccccacctgttctggcagcgccccttctgcaggtccctccctctccccctgcctcacccaccctgcaggccccacgccgccccccgaccccgggtccggatacctccgtctcgggcccacggctgaccctggcgttggcccccggcccgccgccgccgccctcgcgcagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccacagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgca

SEQ ID NO: 169466 - DNA, 1261 bp, Homo sapiens
  Payload ID: 13372
  Gene Symbol: PRR36
  Gene Name: proline rich 36
  ENST ID: ENST00000615988
  CDS Start-End: 1-826
ctctcctcgaccccctcccccagtaactcccgcagccctccgagttctgggagctgcgggagcagtggggcgaaagcctctggcagagcgagcggggggcatcggcggggccactattcccgagtctgctccccgagcgggaccaacgcggagtgctgggacaagttcccgaaaccctgcctccaggcccccagcctctgggagaggggagagagctcctcctgccaagaacaccagcccaggccctgtttctagcccagggcgtgccagcgggaccaccaggccaggccctcttggccagaagggactccggatctcagcggaggaaactgtggccagaggaaaagctacagaggctcccaaaaggagtgccctcagcgctggggcacggagagcccgttctgggccctcagcccgcggaacacccagggctcctgcgcatccctcgcagcccaagccgaaaggactgcaggctctgcgaccccctcaggtcacacccccaaggaaggacgcagccccagcactaggaccgctttcttcctctcctttggccacaccctctccatcgggtaccaagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactg

SEQ ID NO: 169467 - DNA, 563 bp, Homo sapiens
  Payload ID: 13373
  Gene Symbol: PRR4
  Gene Name: proline rich 4 (lacrimal)
  Uniprot ID: Q16378
  ENST ID: ENST00000228811
  CDS Start-End: 39-443
aacgcagagttgggagcaactccagagcctccttcaagatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaa

SEQ ID NO: 169468 - DNA, 326 bp, Homo sapiens
  Payload ID: 13373
  Gene Symbol: PRR4
  Gene Name: proline rich 4 (lacrimal)
  Uniprot ID: Q16378
  ENST ID: ENST00000544994
  CDS Start-End: 34-231
agagttgggagcaactccagagcctccttcaagatgctgctggtcctgctctcagtggtccttctggctctgagctcagctcagagcacagataatgatgtgaactatgaagactttactttcaccataccagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaa

SEQ ID NO: 169469 - DNA, 388 bp, Homo sapiens
  Payload ID: 13373
  Gene Symbol: PRR4
  Gene Name: proline rich 4 (lacrimal)
  ENST ID: ENST00000540107
  CDS Start-End: 39-275
aacgcagagttgggagcaactccagagcctccttcaagatgctgctggtcctgctctcagtggtccttctggctctgagctcagctcagagcacagataatgatgtgaactatgaagactttactttcaccataccagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgc

SEQ ID NO: 169470 - DNA, 563 bp, Homo sapiens; identical to SEQ ID NO: 169467
  Payload ID: 13373
  Gene Symbol: PRR4
  Gene Name: proline rich 4 (lacrimal)
  Uniprot ID: Q16378
  ENST ID: ENST00000574424
  CDS Start-End: 39-443

SEQ ID NO: 169471 - DNA, 388 bp, Homo sapiens; identical to SEQ ID NO: 169469
  Payload ID: 13373
  Gene Symbol: PRR4
  Gene Name: proline rich 4 (lacrimal)
  ENST ID: ENST00000574037
  CDS Start-End: 39-275

SEQ ID NO: 169472 - DNA, 326 bp, Homo sapiens; identical to SEQ ID NO: 169468
  Payload ID: 13373
  Gene Symbol: PRR4
  Gene Name: proline rich 4 (lacrimal)
  Uniprot ID: Q16378
  ENST ID: ENST00000576999
  CDS Start-End: 34-231

SEQ ID NO: 169473 - DNA, 563 bp, Homo sapiens; identical to SEQ ID NO: 169467
  Payload ID: 13373
  Gene Symbol: PRR4
  Gene Name: proline rich 4 (lacrimal)
  Uniprot ID: Q16378
  ENST ID: ENST00000614435
  CDS Start-End: 39-443

SEQ ID NO: 169474 - DNA, 889 bp, Homo sapiens
  Payload ID: 13373
  Gene Symbol: PRR4
  Gene Name: proline rich 4 (lacrimal)
  ENST ID: ENST00000535024
  CDS Start-End: 326-769
gggagtcggccatcatgctggccccggaggccgttagcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccagctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaa

SEQ ID NO: 169475 - DNA, 603 bp, Homo sapiens
  Payload ID: 13373
  Gene Symbol: PRR4
  Gene Name: proline rich 4 (lacrimal)
  ENST ID: ENST00000613368
  CDS Start-End: 39-539
agcacaaagttgggagtgacaccagagcctcctgcaagatgcttctgattctgctgtcagtggccctgctggccttcagctcagctcaggatttaaatgaagatgtcagccaggaagatgttcccctcgtaatatcagatggaggagactctgagcagttcctagatgaggagcgtcagggaccacctttgggaggacagcaatctcaaccctctgctggtgatgggaaccaggatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagataacagtgtttcaaatgccgtgaaacatgg

SEQ ID NO: 169476 - DNA, 326 bp, Homo sapiens; identical to SEQ ID NO: 169468
  Payload ID: 13373
  Gene Symbol: PRR4
  Gene Name: proline rich 4 (lacrimal)
  Uniprot ID: Q16378
  ENST ID: ENST00000632373
  CDS Start-End: 34-231

SEQ ID NO: 169477 - DNA, 889 bp, Homo sapiens
  Payload ID: 13373
  Gene Symbol: PRR4
  Gene Name: proline rich 4 (lacrimal)
  ENST ID: ENST00000631790
  CDS Start-End: 326-769
gggagtcggccatcatgctggccccggaggccgttagcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgaggttctccagcatttggctcaaggccccaagggcacatgtgacaagaaggcgccggctttttaaacattggaagttcttctgtgtcagttctgtgacagaacatttacttaacacatcatgaaggctagtttggatgtggaggggaatagactccatctatccatatgagctgctgcagaagaatattttgcctgctggaacctgctgtatctactcaagagtggaagttttcacagatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaa

SEQ ID NO: 169478 - DNA, 388 bp, Homo sapiens; identical to SEQ ID NO: 169469
  Payload ID: 13373
  Gene Symbol: PRR4
  Gene Name: proline rich 4 (lacrimal)
  ENST ID: ENST00000633483
  CDS Start-End: 39-275

SEQ ID NO: 169479 - DNA, 1767 bp, Homo sapiens
  Payload ID: 13374
  Gene Symbol: PRR5
  Gene Name: proline rich 5 (renal)
  Uniprot ID: P85299
  ENST ID: ENST00000006251
  CDS Start-End: 195-1334
attcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctg

SEQ ID NO: 169480 - DNA, 1878 bp, Homo sapiens
  Payload ID: 13374
  Gene Symbol: PRR5
  Gene Name: proline rich 5 (renal)
  Uniprot ID: P85299
  ENST ID: ENST00000336985
  CDS Start-End: 278-1444
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 169481 - DNA, 789 bp, Homo sapiens
  Payload ID: 13374
  Gene Symbol: PRR5
  Gene Name: proline rich 5 (renal)
  ENST ID: ENST00000403696
  CDS Start-End: 258-789
ccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtga

SEQ ID NO: 169482 - DNA, 2279 bp, Homo sapiens
  Payload ID: 13374
  Gene Symbol: PRR5
  Gene Name: proline rich 5 (renal)
  Uniprot ID: P85299
  ENST ID: ENST00000403581
  CDS Start-End: 610-1845
agtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagagtcccttcagtgacttcgagcgtgcattgagagcccagtaacactggggggcaactgccacaaagacacagcctcagccaggcgcagtgactcatgcctgtaatcccagcaccttgggaggccaaggcttgtggatcacctgaggtcaggagtttgagaccagccggaccaacatggagaaaccccatctctactaaaaatacaaaaaaattagctaggcattgtggcgcatgcctgtaatcccggctactcgggaggctgagggaggagaagcacttgaacccaggaggcgcggttgcagtgagccgagatcgccccattgcactccagcctgggcaacaagagcgaaactccatctcaaaataataataataacaataatagtaagactcagcctccccgctctgggacactcagtctgatggggcaggctggtcagaagacatagagccatggtgtgtttggaactttcacagagggaagcctggggctcgggaagcccggaaaagatgccggcgcagcctgagggcttgtacaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 169483 - DNA, 1430 bp, Homo sapiens
  Payload ID: 13374
  Gene Symbol: PRR5
  Gene Name: proline rich 5 (renal)
  ENST ID: ENST00000432916
  CDS Start-End: 17-358
ccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtgga

SEQ ID NO: 169484 - DNA, 905 bp, Homo sapiens
  Payload ID: 13374
  Gene Symbol: PRR5
  Gene Name: proline rich 5 (renal)
  ENST ID: ENST00000432186
  CDS Start-End: 104-905
ctccgcggccccctcccccggccccgggctccggctccggctccggctctggctctgcgcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtacca

SEQ ID NO: 169485 - DNA, 1612 bp, Homo sapiens
  Payload ID: 13374
  Gene Symbol: PRR5
  Gene Name: proline rich 5 (renal)
  ENST ID: ENST00000431834
  CDS Start-End: 257-625
cgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtct

SEQ ID NO: 169486 - DNA, 881 bp, Homo sapiens
  Payload ID: 13374
  Gene Symbol: PRR5
  Gene Name: proline rich 5 (renal)
  ENST ID: ENST00000457960
  CDS Start-End: 203-881
ccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctcc

SEQ ID NO: 169487 - DNA, 1726 bp, Homo sapiens
  Payload ID: 13374
  Gene Symbol: PRR5
  Gene Name: proline rich 5 (renal)
  Uniprot ID: P85299
  ENST ID: ENST00000617066
  CDS Start-End: 411-1292
agccccccagctccggcggacccgggtgggcgtgcccgcggacccgcttgccgcacttaggcgagtctcccctgcagcgccccgagtccctgggggctgcggcggctgcgggcgcccccgcgcgggcccgaggggcgggacgcggcggagcggggcggggcggggcctccgcggccccctcccccggccccgggctccggctccggctccggctctggctctgcgcggtggcagcggcggcggcggcgcggggaccgagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 169488 - DNA, 1843 bp, Homo sapiens
  Payload ID: 13374
  Gene Symbol: PRR5
  Gene Name: proline rich 5 (renal)
  Uniprot ID: P85299
  ENST ID: ENST00000611394
  CDS Start-End: 270-1409
agccccccagctccggcggacccgggtgggcgtgcccgcggacccgcttgccgcacttaggcgagtctcccctgcagcgccccgagtccctgggggctgcggcggctgcgggcgcccccgcgcgggcccgaggggcgggacgcggcggagcggggcggggcggggcctccgcggccccctcccccggccccgggctccggctccggctccggctctggctctgcgcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 169489 - DNA, 1900 bp, Homo sapiens
  Payload ID: 13374
  Gene Symbol: PRR5
  Gene Name: proline rich 5 (renal)
  Uniprot ID: P85299
  ENST ID: ENST00000624862
  CDS Start-End: 585-1466
caggaaggggtgctctgtgggcttggaggatgcaggcgccttcctggggactgctctgtgagcagtgataaaatatttatcagccagcagctgggcttccctgcatagggtgcagtcgggggcagctcccacccgagcctgcagcctgagttctgctgagtcatgggggagcccagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 169490 - DNA, 3930 bp, Homo sapiens
  Payload ID: 13375
  Gene Symbol: PRR5L
  Gene Name: proline rich 5 like
  Uniprot ID: Q6MZQ0
  ENST ID: ENST00000378867
  CDS Start-End: 356-1462
ggggcagctgggccgggggcgggggtcggctgcagatctcccgttgtgtgagagaaacgcaagcacggagctcccttgacctgctgcatcctcctcggcaattttttttttttaagtcaaaaagcttggatttcctgaaattgttgaactggatgcgcgcggagtctggggcggaggcgagcggcgggtgtgcgcgactcggggtgattcacgccggggaccccaaggaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatgtaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagagtttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcgtgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgtta

SEQ ID NO: 169491 - DNA, 577 bp, Homo sapiens
  Payload ID: 13375
  Gene Symbol: PRR5L
  Gene Name: proline rich 5 like
  ENST ID: ENST00000530252
  CDS Start-End: 429-577
aacgtgtcaccagcccggctgtgggagctccgcggccgaagcgtttgttgactcgcgctggagaggaaccgaggctggacgggaccccatctgagggcagagctgggggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccag

SEQ ID NO: 169492 - DNA, 592 bp, Homo sapiens
  Payload ID: 13375
  Gene Symbol: PRR5L
  Gene Name: proline rich 5 like
  ENST ID: ENST00000526728
  CDS Start-End: 366-592
accagagactcctgccttccattggcgaaccggtcaccggctccgtcctgaaaacagaacttgctccgagtgataagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgc

SEQ ID NO: 169493 - DNA, 554 bp, Homo sapiens
  Payload ID: 13375
  Gene Symbol: PRR5L
  Gene Name: proline rich 5 like
  ENST ID: ENST00000530050
  CDS Start-End: 329-554
attttccttgaggccgccgcccggggtgggaccaggctgtgtgcttgctaactgtgcttcaggaatccgctctgggatgccttcctgtctggcaaaaggggttacccccagttctacccagtccctgtcctcggtcacatgctgccgccgcctcttcccccgcggtgccgggagcccgcgttttgtttgtcagcagttaggcggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatg

SEQ ID NO: 169494 - DNA, 548 bp, Homo sapiens
  Payload ID: 13375
  Gene Symbol: PRR5L
  Gene Name: proline rich 5 like
  ENST ID: ENST00000524380
  CDS Start-End: 404-548
agttgctgaaggggaggaggagtgagatggggtgaagcgcgcggagtctggggcggaggcgagcggcgggtgtgcgcgactcggggtgattcacgccggggaccccaaggagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagct

SEQ ID NO: 169495 - DNA, 544 bp, Homo sapiens
  Payload ID: 13375
  Gene Symbol: PRR5L
  Gene Name: proline rich 5 like
  ENST ID: ENST00000527172
  CDS Start-End: 402-544
acatttattgtgcccaagacttttgtgggctctctgccaggaaagggcaggtcattgaatgggccctgggaaaaatgatgtctgagcttctctccagttctcagagaaagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgag

SEQ ID NO: 169496 - DNA, 572 bp, Homo sapiens
  Payload ID: 13375
  Gene Symbol: PRR5L
  Gene Name: proline rich 5 like
  ENST ID: ENST00000532121
  CDS Start-End: 324-572
ggaacctggcactagaatgtgagcaaaaaagaggcaattctgctgacttcagagaagcttccttgcagaaggaatctgaaacacgagcaactctctggggaggatgagaagctcttctacaaggaggaggaaaacataccttaggctatatggctgctgggaatccaggttaaaatgtttaaccctggagaaaaagaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcgg

SEQ ID NO: 169497 - DNA, 2291 bp, Homo sapiens
  Payload ID: 13375
  Gene Symbol: PRR5L
  Gene Name: proline rich 5 like
  Uniprot ID: Q6MZQ0
  ENST ID: ENST00000530639
  CDS Start-End: 277-1383
agtcttcaggccccaggtcagtgagtggcaagccaggcccagagatctctgcgcccgttggaacatccccttctcgggaggctggaaggccatggtcattcacctctccccagcaaggtgggacctgccctggaagaagaaaccagaccaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgttt

SEQ ID NO: 169498 - DNA, 740 bp, Homo sapiens
  Payload ID: 13375
  Gene Symbol: PRR5L
  Gene Name: proline rich 5 like
  Uniprot ID: Q6MZQ0
  ENST ID: ENST00000527487
  CDS Start-End: 58-675
cgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagccaggcggcactccagggtccggcccaaggtgactgtcctgaactatgcctccccgataaccgcagtcagccggccactgaatgagatggtcttgacc

SEQ ID NO: 169499 - DNA, 783 bp, Homo sapiens
  Payload ID: 13375
  Gene Symbol: PRR5L
  Gene Name: proline rich 5 like
  ENST ID: ENST00000526679
  CDS Start-End: 542-783
tttccctttaggccactcttgtcaatgctcccaacggcctcctccttcctccctgtgctgctctggggaggtctcttggctctgcccggcagtaggaacagtggagacaaagacagcttcacattctcttcagctgtcaggattgagagtggcggattcgggaggagaaaaatgagtcagtggcaactcgttgtgtgtgactgtgcagtttatctgagtccgcgggagccatagtcgtaggctgaaaatgacccttatttaagagaggctgagtgcgtggttgtggctgcccaggcgctttgctggactaggcagcctgggaacactaactgagaagtggacggggacaggagccagcctgcggtcctcagtgtcttacagtttcctggagaagtggatgtttcggcaggaagatggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacat

SEQ ID NO: 169500 - DNA, 805 bp, Homo sapiens
  Payload ID: 13375
  Gene Symbol: PRR5L
  Gene Name: proline rich 5 like
  ENST ID: ENST00000526682
  CDS Start-End: 616-805
cgtaagatgagagaggagggaaacgtgtcaccagcccggctgtgggagctccgcggccgaagcgtttgttgactcgcgctggagaggaaccgaggctggacgggaccccatctgagggcagagctgggggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttt

SEQ ID NO: 169501 - DNA, 1480 bp, Homo sapiens
  Payload ID: 13376
  Gene Symbol: PRR7
  Gene Name: proline rich 7 (synaptic)
  Uniprot ID: Q8TB68
  ENST ID: ENST00000323249
  CDS Start-End: 491-1315
gcgcgcgccccgcgcctccagcccagcgctcggagccgctttcgctgccactgtctgctcccccgggccgccgccgcctccccccgcaggcccggggctctgtccgctgggcccgcgctgctcgccccgagccaggagaacgagctcgaggaggatgcctgggcccggtgcaaggttccccctctcacccgcagctgtggagaggaggaagcggaactagagatgcccatctggagtgagtgcaggaccaggtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtgtgatctggtttggtacaa

SEQ ID NO: 169502 - DNA, 1345 bp, Homo sapiens
  Payload ID: 13376
  Gene Symbol: PRR7
  Gene Name: proline rich 7 (synaptic)
  Uniprot ID: Q8TB68
  ENST ID: ENST00000502922
  CDS Start-End: 374-1198
gagccgctttcgctgccactgtctgctcccccgggccgccgccgcctccccccgcaggcccggggctctgtccgctgggcccgcgctgctcgccccgagccaggagaacgagctcgaggaggatgcctgggcccgtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtg

SEQ ID NO: 169503 - DNA, 1285 bp, Homo sapiens
  Payload ID: 13376
  Gene Symbol: PRR7
  Gene Name: proline rich 7 (synaptic)
  Uniprot ID: Q8TB68
  ENST ID: ENST00000510492
  CDS Start-End: 314-1138
cctgctctgtgagacctgtgttgagtgctctgcatccattatctcctaatttttttttacaacagttgcgcaaggtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtg

SEQ ID NO: 169504 - DNA, 993 bp, Homo sapiens
  Payload ID: 13376
  Gene Symbol: PRR7
  Gene Name: proline rich 7 (synaptic)
  ENST ID: ENST00000507881
  CDS Start-End: 458-993
acggggacctggacatgtgtgtgctctccgagctgagctgtgtgcgcgtccgggttctcgacctcagctgcctggctgtgcatccagcgtgcacgaccggtgtggcctgggctccagcctggagtgtggaccgggtcggccggcgtgtgcctcccctgtgagggtgccctggcgggtgtgagcccggcgggctggagaaccgggtctcggcgccgcaggtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaa

SEQ ID NO: 169505 - DNA, 1229 bp, Homo sapiens
  Payload ID: 13377
  Gene Symbol: PRR9
  Gene Name: proline rich 9
  Uniprot ID: Q5T870
  ENST ID: ENST00000368744
  CDS Start-End: 57-407
agtccacagcctttgttgagtcttgttgaagatcaggctctgcaaatcaccctaggatgtccttcagtgagcagcagtgcaagcagccatgtgtgccccctccatgcctcccaaagacccaggagcagtgccaagcaaaggctgaggaggtgtgcctccccacatgccagcacccctgccaagataagtgtctagtgcaggcccaggaggtatgtctttctcagtgccaggaatcaagtcaagaaaaatgcccacagcaaggccaagagccatacctacctccatgccaagaccagtgtccacctcagtgtgcagagccatgccaggagctattccagacaaaatgtgtggaggtttgcccacagaaagtccaggagaagtgctcatcccctggcaagggaaagtagctgctcatatgtcatctgggttcaagaagatggccagcagatgaaaccctgaccccagcccacgctctggtgaccttcttctgtgggtacctctgtgtgcaatgtaccttcttgcctcctggcttccttagcattccaggacttggtctgtgtctctgaagacagttctttctgtatttcatcaccctctgtgaataagcattgttctcagcagtctgatggaaggtctcaaatgtaggaatggtgtggttgtcagggaagaccacagaagcctagcacagcttccttggtgcaaaaattcacccagctctgggtgtgtaacagccaaggataccttcattcatctttcagagtttcaggctctcaaataagcctcaaaacaaactgaattctgatggactttccacttatcaccaccaccaccacctccaccaccaccaccaccacaggtgttgagacaaagcggcttgcggtgtttcaaaaatcaaaaatttggtgattttgtctctgtacactaaaaagaacagcaaattattgaactttgaaatgttggttgtgcttttttaaaatgaaccgaaagtatgtaaacgattgaatccaaacaaccagaagggaaagataagatggatgtttggtgcccttgtcaatctctgtgcttcatagctggtctaatgtgggcccttagttctcaccatgtacactctttagagatgtgatttgtgtctgtgtgatgcaggctggtctgttctccagcttccttgccttcttctccctggtgaaggtaaaatacataataaagctgatcctaaggctgatatctga

SEQ ID NO: 169506 - DNA, 4493 bp, Homo sapiens
  Payload ID: 13378
  Gene Symbol: PRRG1
  Gene Name: proline rich Gla (G-carboxyglutamic acid) 1
  Uniprot ID: O14668
  ENST ID: ENST00000378628
  CDS Start-End: 163-819
tctttccacctcccttccagtccgctcccggttcctggctccagctaggctcggcagaaataggagcgcgcaggcgcgacgtgcggctcgcagaacggcgagtagcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagaga
